(12) United States Patent
Konermann et al.

(10) Patent No.: US 10,550,372 B2
(45) Date of Patent: Feb. 4, 2020

(54) SYSTEMS, METHODS AND COMPOSITIONS FOR SEQUENCE MANIPULATION WITH OPTIMIZED FUNCTIONAL CRISPR-CAS SYSTEMS

(71) Applicants: The Broad Institute Inc., Cambridge, MA (US); Massachusetts Institute of Technology, Cambridge, MA (US); University of Tokyo, Tokyo (JP); President and Fellows of Harvard College, Cambridge, MA (US)

(72) Inventors: Silvana Konermann, Zurich (CH); Alexandro Trevino, Stanford, CA (US); Mark Brigham, Somerville, MA (US); Fei Ran, Boston, MA (US); Patrick Hsu, San Diego, CA (US); Chie-yu Lin, Boston, MA (US); Osamu Nureki, Kanagawa (JP); Hiroshi Nishimasu, Tokyo (JP); Ryuichiro Ishitani, Tokyo (JP); Feng Zhang, Cambridge, MA (US)

(73) Assignees: The Broad Institute, Inc., Cambridge, MA (US); Massachusetts Institute of Technology, Cambridge, MA (US); University of Tokyo, Tokyo (JP); President and Fellows of Harvard College, Cambridge, MA (US)

( * ) Notice: Subject to any disclaimer, the term of this patent is extended or adjusted under 35 U.S.C. 154(b) by 100 days.

(21) Appl. No.: 15/179,912

(22) Filed: Jun. 10, 2016

(65) Prior Publication Data

US 2016/0355797 A1 Dec. 8, 2016

Related U.S. Application Data

(63) Continuation-in-part of application No. PCT/US2014/070175, filed on Dec. 12, 2014.
(Continued)

(51) Int. Cl.
*C12N 9/22* (2006.01)
*C12N 15/113* (2010.01)
(Continued)

(52) U.S. Cl.
CPC .............. *C12N 9/22* (2013.01); *A61K 38/465* (2013.01); *A61K 48/005* (2013.01);
(Continued)

(58) Field of Classification Search
None
See application file for complete search history.

(56) References Cited

U.S. PATENT DOCUMENTS 7,601,492 B2  10/2009  Fu et al.
8,697,359 B1   4/2014  Zhang
(Continued)

FOREIGN PATENT DOCUMENTS

CN  101228176  7/2008
CN  103388006  11/2013
(Continued)

OTHER PUBLICATIONS

International Search Report dated Jul. 7, 2015, which issued during prosecution of International Application No. PCT/US2014/070175.
(Continued)

*Primary Examiner* — Thomas J. Visone
(74) *Attorney, Agent, or Firm* — Foley & Lardner LLP

(57) ABSTRACT

The invention provides for systems, methods, and compositions for altering expression of target gene sequences and related gene products. Provided are structural information on the Cas protein of the CRISPR-Cas system, use of this information in generating modified components of the CRISPR complex, vectors and vector systems which encode one or more components or modified components of a CRISPR complex, as well as methods for the design and use
(Continued)

of such vectors and components. Also provided are methods of directing CRISPR complex formation in eukaryotic cells and methods for utilizing the CRISPR-Cas system. In particular the present invention comprehends optimized functional CRISPR-Cas enzyme systems.

36 Claims, 171 Drawing Sheets

Specification includes a Sequence Listing.

Related U.S. Application Data

(60) Provisional application No. 62/087,537, filed on Dec. 4, 2014, provisional application No. 62/055,484, filed on Sep. 25, 2014, provisional application No. 61/980,012, filed on Apr. 15, 2014, provisional application No. 61/939,242, filed on Feb. 12, 2014, provisional application No. 61/939,256, filed on Feb. 12, 2014, provisional application No. 61/930,214, filed on Jan. 22, 2014, provisional application No. 61/915,267, filed on Dec. 12, 2013, provisional application No. 61/915,251, filed on Dec. 12, 2013.

(51) Int. Cl.
*A61K 38/46* (2006.01)
*C12N 15/90* (2006.01)
*C12Q 1/6876* (2018.01)
*A61K 48/00* (2006.01)

(52) U.S. Cl.
CPC .......... *C12N 15/113* (2013.01); *C12N 15/902* (2013.01); *C12N 15/907* (2013.01); *C12Q 1/6876* (2013.01); *C12Y 301/00* (2013.01); *C12N 2310/20* (2017.05)

(56) References Cited

U.S. PATENT DOCUMENTS

| | | | |
|---|---|---|---|
| 8,871,445 B2 | 10/2014 | Cong et al. | |
| 8,889,418 B2 | 11/2014 | Zhang et al. | |
| 8,932,814 B2 | 1/2015 | Cong et al. | |
| 8,945,839 B2 | 2/2015 | Zhang | |
| 8,993,233 B2 | 3/2015 | Zhang et al. | |
| 9,549,901 B2 | 1/2017 | Shi et al. | |
| 9,597,357 B2 | 3/2017 | Gregory et al. | |
| 9,623,071 B2 | 4/2017 | Guo et al. | |
| 9,834,791 B2 | 12/2017 | Zhang et al. | |
| 2003/0186238 A1 | 10/2003 | Allawi et al. | |
| 2004/0111221 A1 | 10/2004 | Beattie | |
| 2005/0196851 A1 | 9/2005 | Uckun | |
| 2005/0220796 A1 | 10/2005 | Dynan et al. | |
| 2006/0178297 A1 | 8/2006 | Troy et al. | |
| 2006/0234247 A1 | 10/2006 | Puttaraju et al. | |
| 2007/0016012 A1 | 1/2007 | Hartlep | |
| 2007/0244031 A1 | 10/2007 | Lu et al. | |
| 2010/0055798 A1 | 3/2010 | Battersby | |
| 2010/0076057 A1 | 3/2010 | Sontheimer et al. | |
| 2010/0081707 A1 | 4/2010 | Ali et al. | |
| 2010/0093617 A1 | 4/2010 | Barrangou et al. | |
| 2011/0016540 A1 | 1/2011 | Weinstein | |
| 2011/0059502 A1 | 3/2011 | Chalasani | |
| 2011/0189776 A1 | 8/2011 | Terns et al. | |
| 2011/0223638 A1 | 9/2011 | Wiedenheft et al. | |
| 2011/0239315 A1 | 9/2011 | Bonas et al. | |
| 2012/0029891 A1 | 2/2012 | Behlke et al. | |
| 2013/0130248 A1 | 5/2013 | Haurwitz et al. | |
| 2013/0315831 A1 | 11/2013 | Shi et al. | |
| 2014/0068797 A1 | 3/2014 | Doudna et al. | |
| 2014/0294771 A1 | 10/2014 | Schaffer et al. | |
| 2014/0315985 A1 | 10/2014 | May et al. | |
| 2014/0342456 A1 | 11/2014 | Mali et al. | |
| 2014/0357530 A1† | 12/2014 | Zhang | |
| 2015/0045546 A1 | 2/2015 | Siksnys et al. | |
| 2015/0071899 A1† | 3/2015 | Liu | |
| 2015/0071903 A1 | 3/2015 | Liu et al. | |
| 2015/0071906 A1 | 3/2015 | Liu et al. | |
| 2015/0232881 A1 | 8/2015 | Glucksmann et al. | |
| 2015/0247150 A1 | 9/2015 | Zhang et al. | |
| 2015/0291965 A1 | 10/2015 | Zhang et al. | |
| 2015/0322457 A1 | 11/2015 | Kim et al. | |
| 2015/0353905 A1 | 12/2015 | Weiss et al. | |
| 2016/0017366 A1 | 1/2016 | Chen et al. | |
| 2016/0024510 A1 | 1/2016 | Bikard et al. | |
| 2016/0024524 A1* | 1/2016 | Joung | C12N 9/22 435/462 |
| 2016/0130609 A1 | 5/2016 | Doudna et al. | |
| 2016/0237456 A1† | 8/2016 | Church | |
| 2016/0251648 A1 | 9/2016 | Wang et al. | |
| 2016/0281072 A1 | 9/2016 | Zhang | |
| 2016/0298135 A1 | 10/2016 | Chen et al. | |
| 2016/0298137 A1 | 10/2016 | Chen et al. | |
| 2016/0324938 A1 | 11/2016 | Bikard et al. | |
| 2016/0340662 A1 | 11/2016 | Zhang et al. | |
| 2017/0175144 A1 | 6/2017 | Zhang et al. | |
| 2018/0127783 A1 | 5/2018 | Zhang et al. | |

FOREIGN PATENT DOCUMENTS

| | | |
|---|---|---|
| CN | 103668472 | 3/2014 |
| CN | 104854241 A | 8/2015 |
| EP | 2591770 | 5/2013 |
| EP | 2 784 162 | 1/2014 |
| EP | 2764103 | 8/2014 |
| EP | 2771468 | 9/2014 |
| FR | 2872170 A1 | 12/2005 |
| JP | 2004-519245 A | 7/2004 |
| JP | 2004-537285 A | 12/2004 |
| JP | 2005-509409 A | 4/2005 |
| JP | 2006-513694 A | 4/2006 |
| JP | 2006-518996 A | 8/2006 |
| JP | 2007-501626 A | 2/2007 |
| JP | 2009-502170 A | 1/2009 |
| JP | 2009-536827 A | 10/2009 |
| JP | 2010-522547 A | 7/2010 |
| JP | 2012-508235 | 4/2012 |
| JP | 2012-510812 A | 5/2012 |
| JP | 2012-511332 A | 5/2012 |
| JP | 2012-529287 A | 11/2012 |
| JP | 2013-500045 A | 1/2013 |
| JP | 2013-518602 A | 5/2013 |
| JP | 2013-544077 A | 12/2013 |
| JP | 2014-526279 A | 10/2014 |
| JP | 2015-523856 A | 8/2015 |
| JP | 2016-500003 A | 1/2016 |
| JP | 2016-500262 | 1/2016 |
| JP | 2016-501532 A | 1/2016 |
| JP | 2016-025710 A | 2/2016 |
| JP | 2016-502840 A | 2/2016 |
| JP | 2016-504026 A | 2/2016 |
| JP | 2016-093196 | 5/2016 |
| JP | 2016-516169 A | 6/2016 |
| JP | 2016-517954 A | 6/2016 |
| JP | 2016-131404 A | 7/2016 |
| JP | 2016-520317 A | 7/2016 |
| JP | 2016-521554 A | 7/2016 |
| JP | 2016-521975 A | 7/2016 |
| JP | 2016-182140 A | 10/2016 |
| JP | 2017-501151 A | 1/2017 |
| JP | 2017-501699 | 1/2017 |
| RU | 2009136452 A | 4/2011 |
| WO | WO-02/074968 A1 | 9/2002 |
| WO | WO-02/080851 A2 | 10/2002 |
| WO | WO-03/014318 A2 | 2/2003 |
| WO | WO-03/104414 A2 | 12/2003 |
| WO | WO-2004/029219 A2 | 4/2004 |
| WO | WO-2004/046321 A2 | 6/2004 |
| WO | WO-2004/062618 A2 | 7/2004 |
| WO | WO-2005/049642 A2 | 6/2005 |
| WO | WO-2007/014275 A2 | 2/2007 |
| WO | WO-2007/134161 A2 | 11/2007 |

(56) References Cited

FOREIGN PATENT DOCUMENTS

| WO | WO-2008/093152 A1 | 8/2008 |
|---|---|---|
| WO | 2008108989 | 9/2008 |
| WO | WO-2008/116860 A2 | 10/2008 |
| WO | 2010054108 | 5/2010 |
| WO | WO-2010/065123 A1 | 6/2010 |
| WO | WO-2010/068816 A1 | 6/2010 |
| WO | WO-2010/075424 A2 | 7/2010 |
| WO | WO-2010/079430 A1 | 7/2010 |
| WO | WO-2011/011767 A1 | 1/2011 |
| WO | WO-2011/016840 A2 | 2/2011 |
| WO | WO-2011/064736 A1 | 6/2011 |
| WO | WO-2011/076873 A1 | 6/2011 |
| WO | 2011146121 | 11/2011 |
| WO | WO-2012/012738 A1 | 1/2012 |
| WO | WO-2012/031205 | 3/2012 |
| WO | WO-2012/051343 A1 | 4/2012 |
| WO | WO-2012/149470 A1 | 11/2012 |
| WO | 2012164565 | 12/2012 |
| WO | WO-2013/044008 A2 | 3/2013 |
| WO | 2013071440 A1 † | 5/2013 |
| WO | WO-2013/078400 A1 | 5/2013 |
| WO | 2013082519 | 6/2013 |
| WO | 2013098244 | 7/2013 |
| WO | 2013130824 | 9/2013 |
| WO | 2013141680 | 9/2013 |
| WO | 2013142578 | 9/2013 |
| WO | 2013176772 | 11/2013 |
| WO | WO-2014/165349 A1 | 3/2014 |
| WO | 2014065596 | 5/2014 |
| WO | 2014089290 | 6/2014 |
| WO | 2014093479 | 6/2014 |
| WO | 2014093622 | 6/2014 |
| WO | 2014093635 | 6/2014 |
| WO | 2014093661 | 6/2014 |
| WO | 2014093694 | 6/2014 |
| WO | 2014093712 | 6/2014 |
| WO | 2014099744 | 6/2014 |
| WO | 2014099750 | 6/2014 |
| WO | WO-2014/093595 | 6/2014 |
| WO | WO-2014/093655 | 6/2014 |
| WO | WO-2014/093701 A1 | 6/2014 |
| WO | WO-2014/093709 | 6/2014 |
| WO | WO-2014/093718 | 6/2014 |
| WO | WO-2015/031775 | 8/2014 |
| WO | WO-2014/144761 | 9/2014 |
| WO | WO-2014/186585 A2 | 11/2014 |
| WO | 2014204724 | 12/2014 |
| WO | 2014204725 | 12/2014 |
| WO | 2014204729 | 12/2014 |
| WO | WO-2014/191518 A1 | 12/2014 |
| WO | WO-2014/197568 A2 | 12/2014 |
| WO | WO-2014/197748 | 12/2014 |
| WO | WO-2014/204726 | 12/2014 |
| WO | WO-2014/204727 A1 | 12/2014 |
| WO | WO-2014/204728 | 12/2014 |
| WO | WO-2015/006747 A2 | 1/2015 |
| WO | WO-2015/035136 A2 | 3/2015 |
| WO | WO-2015/048577 | 4/2015 |
| WO | WO-2015/065964 A1 | 5/2015 |
| WO | WO-2015/070083 A1 | 5/2015 |
| WO | WO-2015/071474 A2 | 5/2015 |
| WO | 2015089419 | 6/2015 |
| WO | WO-2015/089351 A1 | 6/2015 |
| WO | WO-2015/089364 | 6/2015 |
| WO | WO-2015/089427 A1 | 6/2015 |
| WO | WO-2015/113063 A1 | 7/2015 |
| WO | WO-2016/022866 A1 | 2/2016 |
| WO | WO-2016/141224 A1 | 9/2016 |

OTHER PUBLICATIONS

Mali, et al. "CAS9 transcriptional activators for target specificity screening and paired nickases for cooperative genome engeneering" Nature Biotechnology, 2013, 31(9):833-838.

Perez-Pinera, et al. "RNA-guided gene activation by CRISPR-Cas9-based transcription factors" Nature Methods, 2013, 10(10):973-976.
Maeder, et al. "CRISPR RNA-guided activation of endogenous human genes" Nature Methods, 2013, 10(10):977-979.
Tae-Yang, et al. "Crystal structure of Cas1 from Archaeoglobus fulgidusand characterization of its nucleolytic activity" Biochemical and Biophysical Research Communications, 2013, 441(4):720-725.
Jinek, et al. "A Programmable Dual-RNA Guided DNA Endonuclease in Adaptive Bacterial Immunity" Science, 2012, 337:816-821.
Jinek, et al. "Supplementary Materials—A Programmable Dual-RNA Guided DNA Endonuclease in Adaptive Bacterial Immunity" Science, 2012, DOI:10.1126/science.1225829.
Nishimasu, et al. "Crystal Structure of Cas9 in Complex with Guide RNA and Target DNA" Cell, 2014, 156(5):935-949.
Patterson, et al. "Codon optimization of bacterial luciferase (lux) for expression in mammalian cells" J. Ind. Microbio. Biotechnology, 2005, 32:115-123.
Platt, et al. "CRISPR-Cas9 Knockin Mice for Genome Editing and Cancer Modeling" Cell, 2014, 159(2):440-455.
Porteus, et al. "Gene targeting using zinc finger nucleases" Nature Biotechnology, 2005, 23(8):967-973.
Pougach, et al. "Transcription, Processing and Function of CRISPR Cassettes in *Escherichia coli*" Mol. Microbiol, 2010, 77(6):1367-1379.
Qi, et al. "Repurposing CRISPR as an RNA-Guided Platform for Sequence-Specific Control of Gene Expression" Cell, 2013, 152(5):1173-1183.
Ran, et al, "In vivo genome editing using *Staphylococcus aureus* Cas9," Nature, 2015, doi:10.1038/nature14299.
Ran, et al. "Genome engineering using the CRISPR-Cas9 system" Nature Protocols, 2013, 8(11):2281-2308.
Rand, et al. "Argonaute2 Cleaves the Anti-Guide Strand of siRNA during RISC Activation" Cell, 2005, 123:621-629.
Raymond, et al. "High-Efficiency FLP and φC31 Site-Specific Recombination in Mammalian Cells" PLoS One, 2007, 2(1):e162. Doi. 10.1371/journal.pone.0000162.
Rebar, et al. "Induction of angiogenesis in a mouse model using engineered transcription factors" Nature Medicine, Dec. 2002, 8(12):1427-1432.
Reiss, et al. "RecA protein stimulates homologous recombination in plants" Proc. Natl. Acad. Sci. USA, 1996, 93:3094-3098.
Sanders, et al. "Use of a macromolecular crowding agent to dissect interactions and define functions in transcriptional activation by a DNA-tracking protein: Bacteriophage T4 gene 45 protein and late transcription" PNAS, 1994, 9:7703-7707.
Sapranauskas, et al. "The *Streptococcus thermophilus* CRISPR-Cas system provides immunity in *Escherichia coli*" Nucleic Acids Research, 2011, 39(21): 9275-9282.
Sauer, "Functional Expression of the cre-lox Site-Specific Recombination System in the Yeast *Saccharomyces cerevisiae*" Mol. Cell. Biol., 1987, 7(6):2087-2096.
Sauer, et al. "Site-specific DNA recombination in mammalian cells by the Cre recombinase of bacteriophage P1" Proc. Natl. Acad. Sci. U.S.A., 1988, 85:5166-5170.
Schiffer, et al. "Predictors of Hepatitis B Cure Using Gene Therapy to Deliver DNA Cleavage Enzymes: A Mathematical Modeling Approach" PLOS Computational Biology,, 2013, 9(7):e1003131. www.ploscompbiol.org.
Scholze, et al. "TAL effector-DNA specificity" Virulence, 2010, 1(5):428-432, DOI:10.4161/viru.1.5.12863.
Schunder, et al. "First indication for a functional CRISPR/Cas system in Francisella tularensis" International Journal of Medical Microbiology, 2013, 303:1438-4221.
Schramm et al. "Recruitment of RNA polymerase III to its target promoters" Genes & Development, 2002, 16:2593-2620.
Seung Woo Cho, et al., "Targeted genome engineering in human cells with the Cas9 RNA-guided endonuclease" Nature Biotechnology, Mar. 2013, 31(3):230-232.
Seung Woo Cho, et al. "Supplementary Information: Targeted genome engineering in human cells with RNA-guided endonuclease" Nature Biotechnology, Mar. 2013, 31(3):1-10.

(56) References Cited

OTHER PUBLICATIONS

Seung Woo Cho, et al. "Analysis off-target effects of CRISPR/Cas-derived RNA-guided endonucleases and nickases" Genome Research, Nov. 2014, 24:132-141.
Shalem et al., "Genome-Scale CRISPR-Cas9 Knockout Screening in Human Cells", Science, 2014, 343;84-87. DOI:10.1126/science.1247005.
Shen, et al. "Efficient genome modification by CRISPR-Cas9 mickase with minimal off-target effects" 2014, Nature Methods, 11(4):399-404.
Shen, et al. "Generation of gene-modified mice via Cas9/RNA-mediated gene targeting" Cell Research, 2013, 23:720-723.
Sims, et al., "High-throughput RNA interference screening using pooled shRNA libraries and next generation sequencing", Genome Biology 12(10):R104, Oct. 2011.
Sontheimer, "Project 7: Establishing RNA-Directed DNA Targeting in Eukaryotic Cells" Physical Sciences-Onc., Nov. 16, 2011-Dec. 31, 2012, htt://groups.molbiosci.northwestern.edu/sontheimer/Sontheimer_cv.php) Molecular Biosciences.
Sosa, et a. "Animal transgenesis: an overiew" Brain Struct Funct, 2010, 214:91-109.
Stolfi, et al, "Tissue-specific genome editing in Ciona embryos by CRISPR/Cas9," Development, 2014, 141:4115-4120 doi:10.1242/dev.114488.
Swiech et al., "In vivo interrogation of gene function in the mammalian brain using CRISPR-Cas9," Nature Biotechnology, 2015, doi:10.1038/nbt.3055.
Terns, et al. "Crispr-based adaptive immune systems" Current Opinion in Microbiology, 2011, 14:321-327.
Tolia, et al. "Slicer and the Argonautes" Nature Chemical Biology, 2007, 3(1):36-43.
Trevino, et al. "Genome Editing Using Cas9 Nickases" Methods in Enxymology, 2014, 546:161-174.
Urnov, et al. "Highly efficient endogenous human gene correction using designed zinc-finger nucleases" Nature, 2005, 435:646-651.
Vestergaard, et al. "CRISPR adaptive immune systems of Archaea" RNA Biology, 2014, 11(2):156-167.
Wang, et al. One-Step Generation of Mice Carrying Mutations in Multiple Genes by CRISPR/Cas-Mediated Genome Engineering, Cell, 2013, 153:910-918.
Wiedenheft, et al. "RNA-guided genetic silencing systems in bacteria and archaea" Nature, 2012, 482:331-338.
Wu, et al. "Genome-wide binding of the CRISPR endonuclease Cas9 in mammalian cells" Nature Biotechnology, 2014, doi:10.1038/nbt.2889.
Xiao, et al. "Chromosomal deletions and inversions mediated by TALENs and CRIPPR/Cas in zebrafish" Nucleic Acids Research, 2013, 41(14):E141. doi:10.1093/nar/gkt464.
Xiao, et al. "Production of High-Titer Recombinant Adeno-Associated Virus Vectors in the Absence of Helper Adenovirus" Journal of Virology, 1998, 72(3):2224-2232.
Zetsche et al. "A split-Cas9 architecture for inducible genome editing and transcription modulation," Nature biotechnology, 2015, 33(2): 139-142.
Zetsche, et al. "CPF1 is a Single RNA-Guided Endonuclease of a Class 2 CRISPR-Cas System" Cell, 2015, 163:759-771.
Zhang, X. D., et al., "cSSMD: assessing collective activity for addressing off-target effects in genome-scale RNA interference screens", Bioinformatics (Oxford), 27(20);2775-2781, Oct. 2011.
Zhang, et al. "Efficient construction of sequence-specific TAL effectors for modulating mammalian transcription" nature biotechnology, 2011, 29(2):149-154.
Zhu, et al. "Crystal structure of Cmr2 suggests a nucleotide cyclase-related enzyme in type III CRISPR-Cas sytems" FEBS Letters, 2012, 939-945. Doi:10.1016/j.febslet2012.02.036.
Hale, et al. "RNA-Guided RNA Cleavage by a CRISPR RNA-Cas Protein Complex" Cell, 2009, 139:945-956.
Hale, et al. "Prokaryotic siliencing (psi) RNAs in Pyrococcus furiosus", RNA, 2008, 14:2572-2579.

Handel, et al. "Versatile and Efficient Genome Editing in Human Cells by Combining Zinc-Finger Nucleases With Adeno-Associated Viral-Vectors" Human Gene Therapy, Mar. 2012, 23:321-329.
Hibbitt, et al. "RNAi-mediated knockdown of HMG CoA reductase enhances gene expression from physiologically regulated low-density lipoprotein receptor therapeutic vectors in vivo" Gene Therapy, 2012, 19:463-467.
Hou, et al., "Efficient genome engineering in human pluripotent stem cells using Cas9 from Neisseria meningitides," PNAS, 2013, 110(39):15644-15649.
Horvath et al. "RNA-guidded genome editing ala carte" Cell Research, 2013, 23:733-734, doi:10.1038/cr.2013.39.
Hsu, et al. "Development and Applications of CRISPR-Cas9 for Genome Engineering" Cell, Jun. 2014, 157: 1262-1278.
Hsu et al., "DNA targeting specificity of RNA-guided Cas9 nucleases," Nature Biotechnology, 2013, 31(9):827-834.
Hsu et al., "Supplementary Information—DNA targeting specificity of RNA-guided Cas9 nucleases," Nature Biotechnology, 2013, doi:10.1038/nbt.2647.
Hwang Woong, et al. "Efficient genome editing in zebrafish using a CRISPR-Cas System" Nature Biotechnology, Mar. 2013, 31(3):227-229.
Hwang Woong, et al. "Efficient In Vivo Genome Editing Usng RNA-Guided Nucleases" Nat. Biotechnol., 2013, 31(3):227.229. doi. 1.1038/mbt.2501.
Janssen, et al., "Mouse Models of K-ras-Initiated Carcinogenesis" Biochimicia et Biophysica Acta, 2005, 1756:145-154.
Jiang, et al. "RNA-guided editing of bacterial genomes using CRISPR-Cas systems" Nature Biotechnology, 2013, 31(3):233-239.
Jinek, et al., "RNA-programmed genome editing in human cells;" 2013, eLife 2013:e00471, DOI:10.7554/eLife.00471.
Kanasty, et al. "Delivery materials for siRNA therapeutics" Nature Materials, 2013, 12:967-977.
Karvelis, et al. "crRNA and tracrRNA guide Cas9-mediated DNA interference in *Streptococcus thermophiles*" RNA Biology, 2013, 10(5):841-851.
Karvelis, et al. "Supplemental Material to: crRNA and tracrRNA guide Cas9-mediated DNA interference in *Streptococcus thermophiles*" Landes Bioscience, 2013, 10(5), http://dx.doi.org/10.4161/rna.24203.
Kim, et al. "Crystal structure of Cas1 from Archaeoglobus fulgidus and characterization of its nucleolytic activity" Biochemical and Biophysical Research Communications, 2013, 441:720-725.
Konermann, et al, "Genome-scale transcriptional activation by an engineered CRISPR-Cas9 complex" Nature, 2015, 517:583-588.
Koornneef, et al. "Apoliprotein B Knockdown by AAV-Delivered shRNA Lowers Plasma Cholesterol in Mice" Molecular Therapy, Apr. 2011, 19( 4)731-740.
Lambowitz, et al. "Group II Introns: Mobile Ribozymes that Invade DNA" Cold Spring Harb Perspect Biol., 2011, 3:a003616.
Larson, et al. "CRISPR interference (CRISPRi) for sequence-specific control of gene expression" Nature Protocols, 2013, 8(11):2180-2196.
Lewis, et al., "The c-myc and PyMT oncogenes induce different tumor types in a somatic mouse model for pancreatic cancer" Genes & Development, 2003, 17:3127-3138.
Li, et al. "In vivo genome editing restores hemostasis in a mouse model of hemophilia" Nature, 2011, 475(7355):217-221. doi: 10.1038/nature10177.
Li, et al. "Multiplex and homologous recombination-mediated genome editing in *Arabidopsis* and Nicotaina benthamiana using guide RNA and Cas9" Nature Biotechnology, 2013, 31(9):688-691.
Lombardo, et al., "Gene editing in human stem cells using zinc finger nucleases and integrase-defective lentiviral vector delivery" Nature Biotechnology, 2007, 25(11):1298-1306.
Luo, et al., "Highly parallel identification of essential genes in cancer cells", Proceeding of the National Academy of Sciences, 2008, 105(51);20380-20385.
Ma, et al. "A Guide RNA Sequence Design Platform for the CRISPR/Cas9 System for Model Organism Genomes", BioMed Research International, 2014, 2013:270805-4. http://dx.doi.org/10.1155/2014/270805.

(56) References Cited

OTHER PUBLICATIONS

Makarova, et al, "Evolution and classification of the CRISPR-Cas Systems" Nature Reviews Microbiology, 2011, 9(6):467-477.
Makarova et al. "Unification of Cas protein families and a simple scenario for the origin and evolution of CRISPR-Cas systms" Biology Direct, 2011, 6:38. http:///www.biology-direct.com/content/6/1/38.
Makarova, et al. "An updated evolutionary classification of CRISPR-Cas systems" Nature Reviews—Microbiology, 2015, 13:722-736.
Mali, et al. "Supplementary Materials for—RNA-Guided Human Genome Engineering Via Cas9" Science, 2013, 339:823-826.
Mali, et al. "RNA-Guided Human Genome engineering Via Cas9" Science, 2013, DOI: 10.1126/SCIENCE.1232033.
Mali, et al. "CAS9 transcriptional activators for target specificity screening and paired nickases for cooperative genome engineering" nature biotechnology, 2013, 31(9):833-840.
Mali, et al. "Supplementary Information: Use of adjacent sgRNA:Cas9 complexes for transcriptional activation and genome engineering" Nature Biotechnoly, doi:10.1037/nbt.2675.
Malina, et al. "Repurposing CRISPR/Cas9 for in situ functional assays" Genes & Development, 2013, 27:2602-2614.
Marraffini, et al. "Self vs. non-self discrimination during CRISPR RNA-directed immunity" Nature, 2010, 463(7280):568-571.
Mastroianni, et al. "Group II Intron-Based Gene Targeting Reactions in Eukaryotes" Plos One, 2008, 3(9):e3121. Doi:10.1371/journal.pone.0003121.
Meshorer, et al. "Chromatin in pluripotent embryonic stem cells and differentiation" Nature Reviews Molecular Cell Biology, 2006, 7:540-546.
Miller, et al. "A TALE nuclease architecture for efficient genome editing" Nature Biotechnology, 2011, 29(2):143-150.
Minton, "How can biochemical reactions within cells differ from those in test tubes?" Journal of Cell Science, 2006, 119:2863-2869.
Mojica, et al. "Short motif sequences determine the targets of the prokaryotic CRISPR defence system", Microbiology, 2009, 155:733-740.
Morgan, et al. "Inducible Expression and Cytogenetic Effects of the EcoRI Restriction Endonuclease in Chinese Hamster Ovary Cells" Molecular and Cellular Biology, 1988, 8(10):4204-4211.
Mukhopadyay, "On the Same Wavelength," ASBMBToday, Aug. 2014, http://www.asbmb.org/asbmbtoday/201408/Features/Doudna/.
Nakamura, et al. "Codon usage tabulated from international DNA sequence databases: status for the year 2000" Nucleic Acids Research, 2000, 28(1): 292.
Nomura, et al., "Low-density lipoprotein receptor gene therapy using helper-dependent adenovirus produces long-term protection against atherosclerosis in a mouse model of familial hypercholesterolemia" Gene Therapy, 2004, 11:1540-1548.
Nishimasu et al. "Crystal Structure of *Staphylococcus aureus* Cas9," Cell 162, 1113-1126, Aug. 27, 2015.
Panyam, et al. "Biodegradable nanoparticles for drug and gene delivery to cells and tissue" Advanced Drug Delivery Reviews, 2003, 55:329-347.
U.S. Appl. No. 14/054,414, filed Oct. 15, 2013, Leith, Nancy J.
U.S. Appl. No. 14/104,837, filed Dec. 12, 2013, Poliakova-Georgan, Ekaterina.
U.S. Appl. No. 14/104,900, filed Dec. 12, 2013, Leith, Nancy J.
U.S. Appl. No. 14/104,990, filed Dec. 12, 2013, Leith, Nancy J.
U.S. Appl. No. 14/105,017, filed Dec. 12, 2013, Leith, Nancy J.
U.S. Appl. No. 14/105,031, filed Dec. 12, 2013, Leith, Nancy J.
U.S. Appl. No. 14/105,035, filed Dec. 12, 2013, Leith, Nancy J.
U.S. Appl. No. 14/183,471, filed Feb. 18, 2014, Leith, Nancy J.
U.S. Appl. No. 14/183,486, filed Feb. 18, 2014, Leith, Nancy J.
U.S. Appl. No. 14/183,512, filed Feb. 18, 2014, Poliakova-Georgan, Ekaterina.
U.S. Appl. No. 14/222,930, filed Mar. 24, 2014, Leith, Nancy J.
U.S. Appl. No. 14/226,274, filed Mar. 26, 2014, Leith, Nancy J.
U.S. Appl. No. 14/256,912, filed Apr. 18, 2014, Leith, Nancy J.
U.S. Appl. No. 14/258,458, filed Apr. 22, 2014, Leith, Nancy J.
U.S. Appl. No. 14/259,420, filed Apr. 23, 2014, Leith, Nancy J.
U.S. Appl. No. 14/290,575, filed May 29, 2014, Whisenant, Ethan C.
U.S. Appl. No. 14/324,960, filed Jul. 7, 2014, Brown, Mindy G.
U.S. Appl. No. 14/463,253, filed Aug. 19, 2014, Zhang, Kaijiang.
U.S. Appl. No. 14/497,627, filed Sep. 26, 2014, Leith, Nancy J.
U.S. Appl. No. 14/523,799, filed Oct. 24, 2014, Leith, Nancy J.
U.S. Appl. No. 14/681,382, filed Apr. 8, 2015, Leith, Nancy J.
U.S. Appl. No. 14/703,511, filed May 4, 2015, Leith, Nancy J.
U.S. Appl. No. 14/738,398, filed Jun. 12, 2015, Ramirez, Delia M.
U.S. Appl. No. 14/973,062, filed Dec. 17, 2015, Leith, Nancy J.
U.S. Appl. No. 14/990,444, filed Jan. 7, 2016, Leith, Nancy J.
U.S. Appl. No. 14/991,083, filed Jan. 8, 2016, Leith, Nancy J.
U.S. Appl. No. 15/160,710, filed May 20, 2016, Leith, Nancy J.
U.S. Appl. No. 15/171,141, filed Jun. 2, 2016, Noakes, Suzanne Marie.
U.S. Appl. No. 15/172,636, filed Jun. 3, 2016, Leonard, Arthur S.
U.S. Appl. No. 15/179,912, filed Jun. 10, 2016, Visone, Thomas J.
U.S. Appl. No. 15/217,489, filed Jul. 22, 2016, Brown, Mindy G.
U.S. Appl. No. 15/229,702, filed Aug. 5, 2016, Leith, Nancy J.
U.S. Appl. No. 15/230,025, filed Aug. 5, 2016, Leith, Nancy J.
U.S. Appl. No. 15/230,161, filed Aug. 5, 2016, Leith, Nancy J.
U.S. Appl. No. 15/430,260, filed Feb. 10, 2017, Leith, Nancy J.
U.S. Appl. No. 15/834,736, filed Dec. 7, 2017.
U.S. Appl. No. 15/838,064, filed Dec. 11, 2017, Leith, Nancy J.
U.S. Appl. No. 15/838,720, filed Dec. 12, 2017.
U.S. Appl. No. 15/887,377, filed Feb. 2, 2018, Leith, Nancy J.
U.S. Appl. No. 15/967,464, filed Apr. 30, 2018, Leith, Nancy J.
U.S. Appl. No. 15/967,495, filed Apr. 30, 2018, Leith, Nancy J.
U.S. Appl. No. 15/967,510, filed Apr. 30, 2018.
U.S. Appl. No. 16/012,692, filed Jun. 19, 2018, Wilder, Cynthia B.
U.S. Appl. No. 16/177,403, filed Oct. 31, 2018, Brown, Mindy G.
U.S. Appl. No. 16/178,551, filed Nov. 1, 2018.
U.S. Appl. No. 61/734,256, filed Dec. 6, 2012, Fuqiang Chen.
U.S. Appl. No. 61/758,624, filed Jan. 30, 2013, Fuqiang Chen.
U.S. Appl. No. 61/761,046, filed Feb. 5, 2013, Scott Knight.
U.S. Appl. No. 61/761,422, filed Mar. 15, 2013, Scott Knight.
U.S. Appl. No. 61/735,876, filed Dec. 11, 2012, Blake A. Wiedenheft.
U.S. Appl. No. 61/799,531, filed Mar. 15, 2013, Blake A. Wiedenheft.
U.S. Appl. No. 61/738,355, filed Dec. 17, 2012, George M. Church.
U.S. Appl. No. 61/799,169, filed Mar. 13, 2012, Prashant Mali.
U.S. Appl. No. 61/613,373, filed Mar. 20, 2012, Virginijus Siksnys.
U.S. Appl. No. 61/625,420, filed Apr. 17, 2012, Virginijus Siksnys.
U.S. Appl. No. 61/652,086, filed May 25, 2012, Martin Jinek.
U.S. Appl. No. 61/716,256, filed Oct. 19, 2012, Martin Jinek.
U.S. Appl. No. 61/736,527, filed Dec. 12, 2012, F. Zhang.
U.S. Appl. No. 61/757,640, filed Jan. 28, 2013, Jinek.
U.S. Appl. No. 61/794,422, filed Mar. 15, 2013, Knight.
International Preliminary Report and Written Opinion of the International Searching Authority dated Jun. 14, 2016, which issued during prosecution of International Application No. PCT/US2014/070175.
Andreas, et al. "Enhanced efficiency through nuclear localization signal fusion on phage C31-integrase: activity comparison with Cre and FLPe recombinase in mammalian cells" Nucleic Acids Research, 2002, 30(11):2299-2306.
Asuri, et al. "Directed Evolution of Adeno-Associated Virus for Enhanced Gene Delivery and Gene Targeting in Human Pluripotent Stem Cells" Molecular Therapy, Feb. 2012, 30(2):329-338.
Al-Attar, et al., "Clustered regularly interspaced short palindromic repeats (CRISPRs): the hallmark of an ingenious antiviral defense mechanism in prokaryotes" Biol Chem., 2011, 392(4):277-289.
Baker, "Gene editing at CRISPR Speed" Nature Biotechnology, 2014, 32(4):309-312.
Banaszewska, et al. "Proprotein Convertase Subtilisin/Kexin Type 9: A New Target Molecule for Gene Therapy" Cellular & Molecular Biology Letters, Feb. 2012, 17(2):228-239.
Barrangou, "RNA-mediated programmable DNA cleavage" Nature Biotechnology, Sep. 2012, 30(9):836-388.
Bergemann, et al. "Excision of specific DNA-sequences from integrated retroviral vectors via site-specific recombination" Nucleic Acids Res., 1995, 23(21):4451-4456.

(56) References Cited

OTHER PUBLICATIONS

Bikard, et al. "CRISPR Interference Can Prevent Natural Transformation and Virulence Acquisition During In Vivo Bacterial Infection" Cell Host & Microbe, Aug. 2012, vol. 12:177-186.
Boch, et al. "Breaking the Code of DNA Binding Specificity of TAL-Type III Effecors" Science, 2009, 326:1509-1512.
Boch, et al. "Xanthomonas AvrBs3 Family-Type III Effectors: Discovery and Function" Annu. Rev. Phytopathol, 2010, Vo. 48:419-436.
Bogdanove, et al. "TAL Effectors:Customizable Proteins for DNA Targeting" Science, 2011, 333:1843-1846.
Briner, et al. "Guide RNA Functional Modules Direct Cas9 Activity and Orthogonality" Molecular Cell, Oct. 2014, 56:333-339.
Carroll, "A CRISPR Approach to Gene Targeting" Molecular Therapy, 2012, 20(9): 1658-1660.
Cermak, et al. Efficient design and assembly of custom TALEN and other TAL Effector-Based Constructs for DNA Targeting, Nucleic Acids Research (2011) vol. 39, No. 12, e82, p. 1-11.
Chen, et al. "Dynamic Imaging of Genomic Loci in Living Human Cells by an Optimized CRISPR/Cas System" Cell, Dec. 2013, vol. 155:1479-1491.
Jieliang Chen, et al. "An Efficient Antiviral Strategy for Targeting Hepatitis B Virus Genome Using Transcription Activator-Like Effector Nucleases" Molecular Therapy, 2014, 22(2):303-311.
Sidi Chen, et al., "Genome-wide CRISPR Screen in a Mouse Model of Tumor Growth and Metastasis," Cell, 2015, 160:1-15, http://dx.doi.org/10.1016/j.cell.2015.02.038.
Cho, et al. "Generation of Transgenic Mice" Curr Protoc Cell Biol., 2011, 19.11.doi:10.1002/0471143030.cb1911s42.
Choulika, et al., "Transfer of Single Gene-Containing Long Terminal Repeats into the Genome of Mammalian Cells by a Retroviral Vector Carrying the cre Gene and the loxP site" Journal of Virology, 1996, 70(3):1792-1798.
Christian, et al. "Targeting DNA Double-Strand Breaks With TAL Effector Nucleases" Genetics, Oct. 2010, vol. 186:757-761.
Christian, et al. "Supporting Information—Targeting DNA Double-Strand Breaks With TAL Effector Nucleases" Genetics, 2010, DOI:10.1534/110.120717:1SI-8SI.
Chylinski, et al. "The tractRNA and Cas9 Families of Type II CRISPR-Cas Immunity Systems" RNA Biology, May 2013, 10(5):726-737.
Cong, et al. "Comprehensive interrogation of natural TALE DNA-binding modules and transcriptional repressor domains" Nature Communications, 2012, 3:968, DOI:10/2038/ncomms1962.
Cong, et al, "Multiplex Genome Engineering Using CRISPR-Cas Systems" Science, 2013, 339:819-823.
Cong, et al, "Supplementary Material: Multiplex Genome Engineering Using CRISPR-Cas Systems" Science Express, Jan. 3, 2013. http://www.sciencemag.org/content/339/6121/819/suppl/DC1.
Connor, "Scientific split—the human genome breakthrough dividing former colleagues," Science, The Independent, Apr. 25, 2014, http://www.independent.co.uk/news/science/scientific-split--the-human-genome-breakthrough-dividing-former-colleagues-9300456.html.
CRISPR-associated endonuclease Cas9; Oct. 21, 2012, XP002738511M, http://ibis/exam/dbfetch.jsp?id=uniprot:J7RUA5.
Dahlman, et al. "In vivo endothelial siRNA delivery using polymeric nanoparticles with low molecular weight" Nat. Nanotechnol., 2014, 9(8)648-655. doi:10.1038/nnano.2014.84.
Datensenko, et al. "Molecular memory of prior infections activates the CRISPR/Cas adaptive bacterial immunity system" Nature Communications, Jul. 10, 2012, 3:935, DOI:10.1038/ncomms1937.
Dingwall, et al. "ABSTRACT: A Polypeptide Domain That Specifies Migration of Nucleoplasmin into The Nucleus" Cell, 1982, 30(2):449-58.
Deltcheva, et al. "CRISPR RNA maturation by trans-encoded small RNA and host Factor RNase III" Nature, Mar. 2011, vol. 471:602-609.
Deltcheva, et al. "Supplementary Information: CRISPR RNA Maturation by Trans-Encoded Small RNA Host Factor RNase III" www.Nature.com/doi:10.1038/nature09886:1-35.
Drittanti, et al. "High throughput production, screening and anyalysis of adeno-associated viral vectors" Gene Therapy, 2000, 7:924-929.
Ebina, et al. "Harnessing the CRISPR/Cas9 system to disrupt latent HIV-1 provirus" Scientific Reports, 2013, 2:2510, doi:10.1038/srep02510.
Ellis, et al. Macromolecular Crowding: Obvious but Underappreciated, Trends in Biochemical Sciences, Oct. 2001, 26(10):597-604.
Ellis, et al. "Zinc-finger nuclease-mediated gene correction using single AAV vector transduction and enhanced by Food and Drug Administration-Approved Drugs" Gene Therapy, 2013, vol. 20:35-42.
Enyeart, et al., "Biotechnological applications of mobile group II introns and their reverse transcriptases: gene targeting, RNA-seq, and non-coding RNA analysis" Mobile DNA, 2014, 5:2, http://www.mobilednajournal.com/contents5/1/2.
Gabriel, et al. "An unbiased genome-wide analysis of zinc-finger nuclease specificity" Nature Biotechnology, Aug. 2011, 29(9):816-823.
Gaj, et al. "ZFN, TALEN, and CRISPR/Cas-Based Methods for Genome Engineering" Trends in Biotechnology, Jul. 2013, 31(7):397-405.
Garneau, et al. "The CRISPR-Cas bacterial immune systems cleaves bacteriophage and plasmid DNA" Nature, Nov. 2010, 468:67-71.
Gasiunas, et al. "Cas9-crRNA ribonucleoprotein complex mediates specific DNA cleavage for adaptive immunity in bacteria" PNAS, Sep. 2012, 109(39): E2579-E2586.
Geißler, et al. "Trancscriptional Activators of Human Genes with Programmable DNA-Specificity" PLone, 2011, 6(5):e19509. Doi:10.1371/hournal.pone.0019509.
Gilbert, et al. "CRISPR-Mediated Modular RNA-Guided Regulation of Transcription in Eukaryotes" Cell, Jul. 2013, 154:442-451.
Goldfarb, et al. "Synthetic peptides as nuclear localization signals" Nature, Aug. 1986, 322(14):641-644.
Grens, Enzyme Improves CRISPR A smaller Cas9 protein enables in vivo genome engineering via viral vectors, The Scientist, Apr. 1, 2015.
Gustafsson, et al. "Codon Bias and heterologous protein expression" Trends in Biotechnology, Jul. 2004, 22(7):346-353.
Haft, et al. "A Guild of 45 CRISPR-Associated (Cas) Protein Families and Multiple CRISPR/Cas Subtypes Exist in Prokaryotic Genomes" PLoS Computational Biology, 2005, 1(6):0474-0483.
Haft, D.H., "HMM Summary p. TIGR04330" 2012, XP-002757584, http://jcvi.org/cgi-bin/tigrfams/HmmReportPage.cgi?acc=TIGR04330.
Hale, et al. "Essential Features and Rational Design of CRISPR RNAs that Function With the Cas RAMP Module Complex to Cleave RNAs" Molecular Cell, 2012, 45(3):292-302.
"Crispr genome engineering" XP055167591, Oct. 5, 2013, https://web.archive.org/web/2013100500 [retrieved on Feb. 5, 2015].
"Fixes, extra genomes, and improvements to the CRISPR Design Tool" Google Groups, XP055167583, Oct. 21, 2013, URL:https://groups.google.com/forum/#!topic/crispr/g9Q8U1tNSis [retrieved on Feb. 5, 2015].
"The CRISPR Revolution," Catalyst Magazine, College of Chemistry, University of California, Berkeley, http://catalyst.berkeley.edu/slideshow/the-crispr-revolution/[Dec. 19, 2014 12:40:53] (Jul. 9, 2014).
Abudayyeh, et al., "C2c2 is a single-component programmable RNA-guided RNA-targeting CRISPR effector," Science, vol. 10, dated 2016.
Addgene Materials May 2015.
Addgene Materials Oct. 2014 including Addgene News 2013.
Addgene Reagent distribution list for Zhang Lab.
Addgene, "gRNA_Cloning Vector", retrieved on Jan. 30, 2019, <https://www/addgenen.org/41824/>, 2 pages.
Alberts, et al., Molecular Biology of The Cell, fourth edition, 2002, 671-676.
*Arbitron, Inc.* v. *Kiefl*, No. 09-CV-04013 PAC, 2010 WL 3239414, at *1 (S.D.N.Y. Aug. 13, 2010).

(56) References Cited

OTHER PUBLICATIONS

Au, et al. "Characterization of a baculovirus nuclear localization signal domain in the late express factor 3 protein", Virology, 2009, 385:209-217.

Ausubel, et al. "Compendium of Methods from Current Protocols in Molecular Biology", Short Protocols in Molecular Biology, Fourth Edition, 1999, 9: 9-3-9-4.

Autofluorescence MIT Flow Cytometry Core Facility (2018), 6 pages.

Baena-Lopez, L., et al., "Accelerated homologous recombination and subsequent genome modification in Drosophila," Development, vol. 140, No. 23, pp. 4818-4825, dated Dec. 2013, 18 pages, including Supplementary Material.

Baiker, et al. "The Immediate-Early 63 Protein of Varicella-Zoster Virus: Analysis of Functional Domains Required for Replication In Vitro and for T-Cell and Skin Tropism in the SCIDhu Model In Vivo", Journal of Virology, 2004, 78(3):1181-1194.

Balboa et al., "Conditionally Stabilized dCas9 Activator for Controlling Gene Expression in Human Cell Reprogramming and Differentiation. (plus Supplemental Information)", Stem Cell Reports, vol. 5, No. 3, Sep. 8, 2015, pp. 448-459 16PP.

Barrangou and Van Der Oost (Eds.), "CRISPR-Cas Systems," Springer Heidelberg (2013; written in 2012 before the publication of Cong et al.).

Barrangou, R. et al.: "CRISPR provides acquired resistance against viruses in prokaryotes," Science, vol. 315, pp. 1709-1712, dated Mar. 23, 2007, 5 pages.

Bassett, et al. "Highly Efficient Targeted Mutagenesis of Drosophila with the CRISPR/Cas9 System" Cell Reports, 2013, 4:220-228.

Bassett, et al., "A Genome-Wide CRISPR Library for High-Throughput Genetic Screening in Drosophila Cells," Journal of Genetics and Genomics, vol. 42, pp. 301-309, dated 2015.

Bauer, et al., "An Erythroid Enhancer of BCL11A Subject to Genetic Variation Determines Fetal Hemoglobin Level," Science, vol. 342, pp. 253-257, dated 2013.

Beerli, et al. "Positive and negative regulation of endogenous genes by designed transcription factors:" PNAS, 2000, 97(4):1495-1500.

Beerli, et al. "Toward controlling gene expression at will: Specific regulation of the erbB-2/HER-2 promoter by using polydactyl zinc finger proteins constructed from modular building blocks", Proc. Natl. Acad. Sci., 1998, 95:14628-14633.

Beerli, R., et al., "Engineering polydactyl zinc-finger transcription factors," Nature Biotechnology, vol. 20, pp. 135-141, dated Feb. 2002, 7 pages.

Bennett et al., "Stable transgene expression in rod photoreceptors after recombinant adeno-associated virus-mediated gene transfer to monkey retina", Proc. Natl. Acad. Sci., USA, vol. 96, Aug. 1999, pp. 9920-9925.

Berns, K., et al. "A Large-Scale RNAi Screen in Human Cells Identifies New Components of the p53 Pathway," Nature 2004, vol. 428, pp. 431-437, dated Mar. 25, 2004, 7 pages.

Bhaya, D., et al., "CRISPR-Cas Systems in Bacteria and Archaea: Versatile Small RNAs for Adaptive Defense and Regulation," Annual Review of Genetics, vol. 45, No. 1, pp. 273-297, dated Dec. 15, 2011, 27 pages.

Bikard, et al. Supplementary Information for: "CRISPR Interference Can Prevent Natural Transformation and Virulence Acquisition During In Vivo Bacterial Infection," Cell Host & Microbe, vol. 12, No. 2, pp. 177-186, dated Aug. 16, 2012, 10 pages.

Birch, et al. "Plant Transformation: Problems and Strategies for Practical Application", Annu. Rev. Plant Physiol. Plant Mol. Biol., 1997, 48:297-326.

Bloom et al., "Inactivation of hepatitis B virus replication in cultured cells and in vivo with engineered transcription activator-like effector nucleases", Molecular Therapy, Aug. 20, 2013, vol. 21, No. 10, pp. 1889-1897.

Bobis-Wozowicz, S., et al., "Targeted genome editing in pluripotent stem cells using zinc-finger nucleases," Methods, vol. 53, pp. 339-346, dated 2011, 8 pages.

Boden, et al. "Efficient Gene Transfer of HIV-1-Specific Short Hairpin RNA into Human Lymphocytic Cells Using Recombinant Adeno-associated Virus Vectors", Molecular Therapy, 2004, 9(3):396-402.

Bohm, "The computer program LUDI: A new method for the de novo design of enzyme inhibitors", Journal of Computer-Aided Molecular Design, 1992, vol. 6, pp. 61-78.

Bouard, et al. "Themed Section: Vector Design and Drug Delivery Review, Viral vectors: from virology to transgene expression", British Journal of Pharmacology, 2009, 157:153-165.

Boutros et al.: "Genome-wide RNAi analysis of growth and viability in Drosophila cells," Science, American Association for the Advancement of Science, vol. 303, No. 5659, pp. 832-835, dated Feb. 6, 2004, 4 pages.

Branden, C., and Tooze, J., "Prediction, Engineering, and Design of Protein Structures," Introduction to Protein Structure, Chapter 16, p. 247, Garland Publishing, Inc., New York, dated 1991, 3 pages.

Brouns, S, "A Swiss Army Knife of Immunity," Science, vol. 337, No. 6096, pp. 808-809, dated Aug. 17, 2012, 3 pages.

Brouns, S., et al., "Small CRISPR RNAs Guide Antiviral Defense in Prokaryotes," Science, vol. 321, pp. 960-964, dated Aug. 15, 2008, 6 pages.

Campeau, et al. "A Versatile Viral System for Expression and Depletion of Proteins in Mammalian Cells", PLoS One, 2009, 4(8):e6529.

Canver, et al., "BCL11A enhancer dissection by Cas9-mediated in situ saturating mutagenesis," Nature, vol. 527, pp. 192-197, including Supplementary Material, dated 2015.

Carr, et al., "Genome engineering", Nature Biotechnology, 2009, 27(12):1151-1162.

Carroll, "Genome Engineering With Zing-Finger Nucleases", Genetics, 2011, 188:773.782.

Carroll, "Progress and prospects: Zinc-finger nucleases as gene therapy agents", Gene Therapy, 2008, 15:1463-1468.

Chan, et al. "Characterization of the Kinetochore Binding Domain of CENP-E Reveals Interactions with the Kinetochore Proteins CENP-F and hBuBR1", The Journal of Cell Biology, 1998, 143:49-63.

Chan, Wai-Ting, et al. "Toxin-Antitoxin Genes of the Gram-Positive Pathogen Streptococcus pneumoniae: So Few and Yet So Many", Microbiology and Molecular Biology Reviews, 2012, 76(4):773-791.

Chang, N., et al. "Genome editing with RNA-guided Cas9 nuclease in Zebrafish embryos", Cell Research, vol. 23, pp. 465-472, dated Mar. 26, 2013, 8 pages.

Chen, Fuqiang et al. "High-frequency genome editing using ssDNA oligonucleotides with zinc-finger nucleases". Nature Methods, 2011, 8(9):753-755, including Supplemental Online Methods.

Chinnasamy, D., et al., "Multicistronic lentiviral vectors containing the FMCV 2A Cleavage factor demonstrate robust expression of encoded genes at limiting MOI," Virology Journal, vol. 3, No. 4, dated Mar. 15, 2006, 16 pages.

Chiu et al, "Engineered GFP as a vital reporter in plants", Current Biology, (1996), 6(3):325-330.

Chou, JY, and Mansfield, BC, "Recombinant AAV-directed gene therapy for type I glycogen storage diseases," Expert Opinion on Biological Therapy, vol. 11, No. 8, pp. 1011-1024, dated Apr. 20, 2011, 21 pages.

Chylinski, et al. "Classification and evolution of type II CRISPR-Cas systems", Nucleic Acids Research, 2014, 42(10):6091-6105,doi:10.1093lnarlgku241.

Clark, K., et al., "A Tale of Two Nucleases: Gene Targeting for the Masses?" Zebrafish, vol. 8, No. 3, pp. 147-149, dated 2011, 3 pages.

Cockrell, "Berkeley's Wikipedian-in-residence is a first," NewsCenter, Feb. 25, 2014.

Community Corner, "CRISPR technology for gene therapy," Nature Medicine, vol. 20, No. 5, pp. 476-477, dated May 2014, 3 pages.

Cong, et al., Oct. 5, 2012 Manuscript including Supplementary Materials, "CRISPR-Assisted Mammalian Genome Engineering," published as "Multiplex Genome Engineering Using CRISPR-Cas Systems," Science, vol. 339, pp. 819-823, dated Feb. 15, 2013, 36 pages.

(56) References Cited

OTHER PUBLICATIONS

Cong, L., et al., "In Vivo Genome Engineering With AAV Vector Carrying CRISPR-Cas9 System," Molecular Therapy, vol. 22, Supplement 1, p. S214, dated May 23, 2014, 1 page.
Cong, L., et al., Supplementary Material for: "Multiplex Genome Engineering Using CRISPR-Cas Systems," Science Express, dated Jul. 5, 2012.
Costantino, et al., "Enhanced levels of alpha Red-mediated recombinants in mismatch repair mutants", PNAS, 100(26):15748-15753.
Cotropia, et al., "Copying in Patent Law," N.C.L. Rev., Stanford Public Law Working Paper No. 1270160 (2009), 87:1421.
Cummings et al., "Fourteen and counting: unraveling trinucleotide repeat diseases", Human Molecular Genetics, 2000, vol. 9, No. 6, pp. 909-916.
Daboussi, F., et al., "Chromosomal context and epigenetic mechanisms control the efficacy of genome editing by rare-cutting designer endonucleases," Nucleic Acids Research, vol. 40, No. 13, pp. 6367-6379, dated Jul. 13, 2012, 13 pages.
Dai, et al. "Genes:Structures and Regulation: The Transcription Factors GATA4 and dHAND Physically Interact to Synergistically Activate Cardiac Gene Expression through a p300-dependent Mechanism", J. Biol. Chem., 2002, 277:24390-24398.
Daley, J., and Wilson, T., "Rejoining of DNA Double-Strand Breaks as a Function of Overhang Length," Molecular and Cellular Biology, vol. 25, No. 3, pp. 896-906, dated Feb. 2005, 11 pages.
Damian, M., and Porteus, M., "A Crisper Look at Genome Editing: RNA-guided Genome Modification," Molecular Therapy, vol. 21, No. 4, pp. 720-722, dated Apr. 2013, 3 pages.
Database GenBank, "*Staphylococcus aureus* subsp.*aureus* ORFX gene and pseudo SCCmec-SCC-SCCCRISPR element, strain M06/0171," Accession No. HE980450, http://www.ncbi.nlm.nih.gov/nuccore/HE980450, dated Aug. 18, 2016, 22 pages.
Database GenBank: "CRISPR-associated protein, Csn1 family, *Staphylococcus pseudintermedius* ED99," Accession No. ADX75954, http://www.uniprot.org/uniprot/G1UFN3.txt?version=3, dated Nov. 21, 2011, 1 page.
Database UniProtKB/TrEMBL [online], Accession No. Q0P897, "The genome sequence of the food-borne pathogen Campylobacter jejuni reveals hypervariable sequences," Subname: Full=Putative CRISPR-associated protein, Oct. 3, 2012 uploaded, [retrieved on Nov. 22, 2017], URL, http://www.uniprot.org/uniprot/Q0P897.txt?version=28.
Database UniProtKB/TrEMBL, Accession No. D0W2Z9, http://www.uniprot.org/uniprot/D0W2Z9.txt?version=4, dated Oct. 3, 2012, 1 page.
Database UniProtKB/TrEMBL, Accession No. G1 UFN3, http://www.uniprot.org/uniprot/G1UFN3.txt?version=3, dated Oct. 3, 2012, 1 page.
Database UniProtKB/TrEMBL, Accession No. J3TRJ9, http://www.uniprot.org/uniprot/J3TRJ9.txt?version=2, dated Oct. 31, 2012, 1 page.
Database UniProtKB/TrEMBL, Accession No. Q0P897, http://www.uniprot.org/uniprot/Q0P897.txt?version=28, dated Oct. 3, 2012, 1 page.
Database UniProtKB/TrEMBL, Accession No. Q6NKI3, http://www.uniprot.org/uniprot/Q6NKI3.txt?version=43, dated Jun. 13, 2012, 1 page.
Database UniProtKB/TrEMBL, Accession No. Q73QW6, http://www.uniprot.org/uniprot/Q73QW6.txt?version=4, dated Nov. 28, 2012, 2 pages.
Database WPI, Week 201437 Thomson Scientific, London, GB; AN 2014-J79552, XP-002737563, 2 pages.
Declaration of Feng Zhang for U.S. Appl. No. 14/054,414 dated Jan. 30, 2014, 10 pages.
Declaration of Paul Simons dated Dec. 22, 2015.
Dicarlo, et al. "Genome engineering in *Saccharomyces cerevisiae* using CRISPTR-Cas systems", Nucleic Acids Research, 2013, 41(7):4336-4343, doi:10.1093/nar/gkt135.
Dingwall, et al. "The Nucleoplasmin Nuclear Location Sequence Is Larger and More Complex than That of SV-40 Large T Antigen", The Journal of Cell Biology, 1988, 107:841-849.
Do, et al. "Identification of multiple nuclear localization signals in murine Elf3, an ETS transcription factor" FEBS Letters, 2006, 580:1865-1871.
Doench, et al., "Rational design of highly active sgRNAs for CRISPR-Cas9-mediated gene inactivation," Nature Biotechnology, vol. 32, No. 12, pp. 1262-1267, including Supplementary Material, dated 2014.
Dominguez, et al., "Beyond editing: repurposing CRISPR-Cas 9 for precision genome regulation and interrogation" Nat Rev Mol Cell Biol., 2016, 17(1):5-15, doi:10.1038/nrm.2015.2.
Dong, et al. "The crystal structure of Cpf1 in complex with CRISPR RNA," Nature, vol. 532, pp. 523-525, including Research Letter, dated 2016.
Dworetzky, S., et al., "The Effects of Variations in the Number and Sequence of Targeting Signals on Nuclear Uptake," The Journal of Cell Biology, vol. 107, pp. 1279-1287, dated Oct. 1988, 9 pages.
Ellis, Hilary, et al. "High efficiency mutagenesis, repair, and engineering of chromosomal DNA using single-stranded oligonucleotids" PNAS, 2001, 98(12):6742-6746.
Espinoza, et al., "Characterization of the structure, function, and mechanism of B2 RNA, an ncRNA repressor of RNA polymerase II transcription", RNA, 2007, 13(4):583-596.
Excerpt from Declaration of Feng Zhang, dated Sep. 9, 2015.
Federal Circuit decision in *Dow Chemical Co.* v. *Nova Chemicals Corp.*, Appeal Nos. 2014-1431, 2014-1462 (Fed. Cir. Aug. 28, 2015) (*Dow* v. *Nova*), 25 pages.
Feldgarden et al., "*Staphylococcus aureus* M0408 acrHk-supercont1.1, whole genome shotgun sequence", NCBI Reference Sequence: NK_KB821326.1, Direct Submission, Dec. 10, 2012, pp. 1-4.
Fieck, et al. "Modifications of the *E.coli* Lac repressor for expression in eukaryotic cells: effects of nuclear signal sequences on protein activity and nuclear accumulation", Nucleic Acids Research, 1992, 20(7):1785-1791.
Fischer-Fantuzzi, L., and Vesco, C., "Cell-dependent efficiency of reiterated nuclear signals in a mutant simian virus 40 oncoprotein targeted to the nucleus," Molecular and Cellular Biology, vol. 8, No. 12, pp. 5495-5503, dated 1988, 10 pages.
Fleming, J., et al.: "Adeno-Associated Virus and Lentivirus Vectors Mediate Efficient and Sustained Transduction of Cultured Mouse and Human Dorsal Root Ganglia Sensory Neurons," Human Gene Therapy, vol. 12, pp. 77-86, dated Jan. 1, 2001, 10 pages.
Foecking, et al. "Powerful and versatile enhance-promoter unit for mammalian expression vectors", Gene, 1986, 101-105.
Fonfara et al., "Phylogeny of Cas9 determines functional exchangeability of dual-RNA and Cas9 among orthologous type II CRISPR-Cas systems", Nucleic Acids Research, 2014, vol. 42, No. 4, pp. 2577-2590.
Freitas, et al. "Mechanisms and Signals for the Nuclear Import of Proteins", Current Genomics, 2009, 10:550-557.
Fu et al, "Targeted genome editing in human cells using CRISPR/Cas nucleases and truncated guide RNAsc", Jan. 1, 2014, The Use of CRISPR/Cas9 ZFNs and Talens in Generating Site-Specific Genome Alterations; Methods in Enzymology; ISSN 1557-7988, vol. 546, Elsevier, NL, pp. 21-45.
Fu, et al. "High-frequency off-target mutagenesis induced by CRISPR-Cas nucleases in human cells", Nature Biotechnology, 2013, 31(9):822-826.
Gaj, T., et al., "Targeted Gene knockout by direct delivery of zinc-finger nuclease proteins," Nature Methods, vol. 9, No. 8, pp. 805-807, dated Aug. 2012, 5 pages.
Gao, et al. "Engineered Cpf1 Enzymes with Altered PAM Specificities", BioRxiv Preprint, XP-002769442, 2016, doi:http://dx.doi.org/10.1101/091611, 1-13, including Figure Legends.
Gao, et al. "Engineered Cpf1 variants with altered PAM specificities", Nature Biotechnology, 2017, 1-4, doi:10.1038/nbt.3900, advanced online publication including Supplementary Information.
Garcia-Bustos, et al. "Nuclear protein localization", Biochimica et Biophysica Acta, 1991, 1071:83-101.

(56) References Cited

OTHER PUBLICATIONS

Gardlik, R., et al., "Vectors and delivery systems in gene therapy," Medical Science Monitor, vol. 11, No. 4, pp. RA110-RA121, dated Apr. 1, 2005, 12 pages.
Garg, et al. "Engineering synthetic TAL effectors with orthogonal target sites", Nucleic Acids Research, 2012, 40(15):7584-7595, doi:10.1093/nar/gks404.
Garriga-Canut, M., et al., "Synthetic zinc finger repressors reduce mutant huntingtin expression in the brain of R6/2 mice," Proceedings of the National Academy of Sciences, vol. 109, No. 45, pp. E3136-E3145, dated Nov. 6, 2012, 10 pages.
Geisinger et al., "In vivo blunt-end cloning tnrough CRISPR /CAS9-facilitated non-homologous end-joining", Nucleic Acid Research Advance Access, Jan. 13, 2016, pp. 1-15.
Gomaa, et al. "Programmable removal of bacterial strains by use of genome-targeting CRISPR-Cas systems", MBio., 2014, 5(1):e00928-13.
Goncalves, M., et al., "Concerted nicking of donor and chromosomal acceptor DNA promotes homology-directed gene targeting in Human Cells," Nucleic Acids Research, vol. 40, No. 8, pp. 3443-3455, dated Dec. 20, 2011, 13 pages.
Gratz, et al. "Genome Engineering of *Drosophila* with the CRISPR RNA-Guided Cas9 Nuclease", Genetics, 2013, 194:1029-1035.
Greenspan, et al. "Two Nuclear Location Signals in the Influenza Virus NS1 Nonstructural Protein", Journal of Virology, 1988, 62(8):3020-3026.
Grieger, J., and Samulski, R., "Packaging Capacity of Adeno-Associated Virus Serotypes: Impact of Larger Genomes on Infectivity and Postentry Steps," Journal of Virology, vol. 79, No. 15, pp. 9933-9944, dated Aug. 2005, 12 pages.
Guan, et al. "Heritable endogenous gene regulation in plants with designed polydactyl zinc finger transcription factors", PNAS, 2002, 99(20):13296-13301.
Habib, N., Assignment to Broad Institute, dated Jun. 9, 2014, 4 pages.
Hall, B., et al., "Overview: Generation of Gene Knockout Mice," Current Protocols in Cell Biology, unit 19.12, suppl. 44, pp. 1-17, dated 2009, 17 pages.
Harrison et al., "A CRISPR view of development", Genes & Development, vol. 28, No. 17, Sep. 1, 2014, pp. 1859-1872.
Heintze, et al. "A CRISPR CASe for high-throughput silencing", Frontiers in Genetics, Oct. 2013, 4(193): DOI:10.3389/gfene.2013.00193.
Hicks, et al. "Protein Import Into the Nucleus: An Integrated View", Annu. Rev. Cell Dev. Biol., 1995, 11:155-188.
Ho, et al, "Targeting non-coding RNAs with the CRISPR/Cas9 system in human cell lines," Nucleic Acids Research, vol. 43, No. 3, p. e17, dated 2015.
Hockemeyer, et al. "Highly efficient gene targeting of expressed and silent genes in human ESCs and iPSCs using zinc finger nucleases", Nat Biotechnol., 2009, 27(9):851-857, doi:10.1038/nbt.1562.
Holkers, M., et al., "Adenoviral vector DNA for accurate genome editing with engineered nucleases," Nature Methods, vol. 11, No. 10, pp. 1051-1057, Aug. 24, 2014, 8 pages (Only Abstract Available).
Holmes, "CRISPR Genome Engineering Resources" XP055167586, Oct. 2, 2013, https://groups.google/forum/#!top1c/crispr/5BpJj_Y3yIG [retrieved on Feb. 5, 2015].
Holmes, "Understanding Scores" XP055167918, Oct. 23, 2013, https://groups.google.com/forum/#!profo_nt50txrP9Yb6e_LXccolb9hNf7gKeMLt6rgaVQ4f0sQ/crispr/fkhX7Fu3r-I/rziHxKT76pYJ [retrieved on Feb. 6, 2015].
Houdebine, L., "The methods to generate transgenic animals and to control transgene expression," Journal of Biotechnology, vol. 98, pp. 145-160, dated 2002, 16 pages.
*Huang v. California Institute of Technology*, 2004 WL 2296330 (C.D. Cal. Feb. 18, 2004).
Hung, S., et al., "AAV-Mediated CRISPR/Cas Gene Editing of Retinal Cells in Vivo," Investigative Ophthalmology & Visual Science, vol. 57, No. 7, pp. 3470-3476, dated Jun. 2016, 7 pages.

Imagawa, et al. "Two nuclear localization signals are required for nuclear translocation of nuclear factor 1-A", FEBS Letters, 2000, 484118-124.
Incontro, S., et al., "Efficient, Complete Deletion of Synaptic Proteins using CRISPR," Neuron, vol. 83, No. 5, pp. 1051-1057, dated Sep. 3, 2014, 13 pages.
Iwamoto et al., "A General Chemical Method to Regulate Protein Stability in the Mammalian Central Nervous System", Chemistry and Biology, Current Biology, London, GB, vol. 17, No. 9, Sep. 24, 2010, pp. 981-988.
Jackson, A., et al. "Widespread siRNA "off-target" transcript silencing mediated by seed region sequence complementarity," RNA 2006, vol. 12, No. 7, dated Mar. 16, 2006, 10 pages.
Jao, et al. "Efficient multiplex biallelic zebrafish genome editing using a CRISPR nuclease system", Proceeding of the National Academy of Sciences, 2013, www.pnas.org/cgi/doi/10.1073/pnas.1308335110.
Jiang, W., et al., "RNA-guided editing of bacterial genomes using CRISPR-Cas systems," Nature Biotechnology, vol. 31, No. 3, pp. 233-239, dated Mar. 2013, 30 pages, including Supplementary Materials.
Jinek, M., et al., "A Programmable Dual-RNA-Guided DNA Endonuclease in Adaptive Bacterial Immunity," Science, vol. 337, pp. 816-821, dated Aug. 17, 2012, Including Supplementary Material, 45 pages.
Jinek, M., et al., Figures and figure supplements for: "RNA-programmed genome editing in human cells," eLIFE, vol. 2, No. e00471, dated Jan. 29, 2013, 5 pages.
Joseph, T., and Osman, R., "Thermodynamic basis of selectivity in guide-target-mismatched RNA interference," Proteins, vol. 80, No. 5, pp. 1283-1298, dated May 2012, 26 pages.
Joshi, et al., "Evolution of I-SceI homing endonucleases with increased DNA recognition site specificity", Journal of Molecular Biology, 2011, 405(1):185-200; ePub: Oct. 26, 2010.
Joung, et al. "TALENs: a widely applicable technology for targeted genome editing", Nat Ref. Mol. Cell Biol., 2013, 14(1):49-55. doi:10.1038/nrm3586.
Kalderon, et al. "A Short Amino Acid Sequence Able to Specify Nuclear Location", Cell, 1984, 39:499-509.
Kiani, et al. "CAS9 gRNA engineering for genome editing, activation and repression", Nature Methods, Advanced Online Publication, 2015, DOI:10.1038/NMETH.3580.
Kim et al., "High Cleavage Efficiency of a 2A Peptide Derived from Porcine Teschovirus-1 in Human Cell Lines, Zebrafish and Mice," PLoS One, 6(4):el 8556, (2011).
Kim, E., et al., "Precision genome engineering with programmable DNA-nicking enzymes," Genome Research, vol. 22, pp. 1327-1333, dated 2012, 8 pages.
Kim, S., et al., "CRISPER RNAs trigger innate immune responses in human cells," Genome Research, pp. 1-7, dated Feb. 22, 2018, 8 pages.
Kinnevery, P., et al., "Emergence of Sequence Type 779 Methicillin-Resistant *Staphylococcus aureus* Harboring a Novel Pseudo *Staphylococcal* Cassette Chromosome mec (SCCmec)-SCC-SCC CRISPR Composite Element in Irish Hospitals," Antimicrobial Agents and Chemotherapy, vol. 57, No. 1, pp. 524-531, dated Jan. 2013, 8 pages.
Kleinstiver et al., "High-fidelity CRISP-Cas9 nucleases with no detectable genome-wide off-target effects", Nature, vol. 529, No. 7587, Jan. 28, 2016, pp. 490-495.
Kleinstiver, et al. "Engineered CRISPR-Cas9 nucleases with altered PAM specificities," Nature, vol. 523, pp. 481-485, including Research Letter, dated 2015.
Kondo, et al. "Highly Improved Gene Targeting by Germline-Specific Cas9 Expression in *Drosphila*", Genetics, 2013, 195:715-721.
Kosugi, et al. "Six Classes of Nuclear Localization Signals Specific to Different Binding Grooves of Importin a . . . " The Journal of Biological Chemistry, 2009, 284(1):478-485.
Kowalski, Thomas J., PowerPoint Presentation, "Interview Sep. 9, 2015."

(56) References Cited

OTHER PUBLICATIONS

Krauer, et al. "Identification of the nuclear localization signals within the Epstein-Barr virus EBNA-6 protein", Journal of General Virology, 2004, 85:165-172.

Kuhlman, et al. "A place for everything$201D Chromosomal intergration of large constructs", Bioengineered Bugs, Jul./Aug. 2010, 1(4)296-299.

Kuhlman, et al. "Site-specific chromosomal integration of large synthetic constructs", Nucleic Acids Research, 2010, 38(6):1-10, doi:10.1093/nar/gkp1193.

Kumar, M., et al., "Systematic Determination of the Packaging Limit of Lentiviral Vectors," Human Gene Therapy, vol. 12, pp. 1893-1905, dated Oct. 10, 2001, 21 pages.

Kuwayama, H., "Enhancement of Homologous Recombination Efficiency by Homologous Oligonucleotides," Cell Interaction Sivakumar Gowder, IntechOpen, DOI: 10.5772/47779, dated Oct. 10, 2012, 12 pages.

Lanford, et al. "Induction of Nuclear Transport with a Synthetic Peptide Homologous to the SV40 T Antigen Transport Signal", Cell, 1986, 46:575-582.

Lange, et al. "Classical Nuclear Localization Signals: Definition, Function, and Interaction with Importin$2026" J. Biol. Chem., 2007, 282(8):5101-5105.

Lebherz, C., et al., "Gene therapy with novel adeno-associated virus vectors substantially diminished atherosclerosis in a murine model of familial hypercholesterolemia," The Journal of Gene Medicine, vol. 6, pp. 663-672, dated Mar. 2, 2004, 10 pages.

Lee, C., et al., "Correction of the F508 Mutation in the Cystic Fibrosis Transmembrane Conductance Regulator Gene by Zinc-Finger Nuclease Homology-Directed Repair," Bioresearch Open Access, vol. 1, No. 3, pp. 99-108, dated 2012, 12 pages.

Leenay, et al. "Identifying and Visualizing Functional PAM Diversity across CRISPR-Cas Systems", Molecular Cell, 2016, 62:137-147.

Lemay, et al. "Folding of the Adenine Riboswitch", Chemistry & Biology, 2006, 13:857-868.

Levitt, J., et al., "Intrinsic fluorescence and redox changes associated with apoptosis of primary human epithelial cells," Journal of Biomedical Optics, vol. 11, No. 6, pp. 064012 1-064012 10, dated Nov./Dec. 2006, 10 pages.

Lewin, et al. "Nuclear localization sequences target proteins to the nucleus" Cells, 2006, 5:224.

Li et al., "Coevolution of CRISPR-Cas system with bacteria and phages", Hereditas, vol. 33, No. 3, Mar. 31, 2011, pp. 213-218.

Li, P., et al., "Biallelic knockout of alpha-1,3 galactosyltransferase gene in porcine liver-derived cells using zing finger nucleases," Journal of Surgical Research, vol. 181, No. 1, pp. E39-E45, dated Jul. 3, 2012, 7 pages.

Li, Ting, et al. "Modularly assembled designer TAL effector nucleases for targeted gene knockout and gene replacement in eukaryotes" Nucleic Acids Research, 2011, 39(14):6315-6325.

Liu, et al. "Epstein-Barr Virus DNase Contains Two Nuclear Localization Signals Which Are Different in Sensitivity to the Hydrophobic Regions" Virology, 1998, 247:62-73.

Los, et al. "Halotag Technology: Cell Imaging and Protein Analysis" Cell Notes, 2006, 14:10-14.

Luo, Ming, et al. "Multiple Nuclear Localization Sequences Allow Modulation of 5-Lipoxygenase Nuclear Import" Traffic, 2004, 5:847-854.

Lyssenko, et al. "Cognate putative nuclear localization signal effects strong nuclear localization of a GFP reporter and facilitates gene expression studies in Caenorhabditis elegans" BioTechniques, 2007, 43:596-600.

Ma, M., et al., "A Guide RNA Sequence Design Platform for the CRISPR/Cas9 System for Model Organism Genomes," Hindawi, vol. 2013, art. 270805, BioMed Research International, dated Sep. 13, 2013, 5 pages.

MacZuga, P., et al., "Embedding siRNA sequences targeting Apolipoprotein B100 in shRNA and miRNA scaffolds results in differential processing and in vivo efficacy," Molecular Therapy, vol. 21, No. 1, pp. 217-227, dated Jan. 2013, 11 pages.

Madisen et al., "A robust and high-throughput Cre reporting and characterization system for the whole mouse brain," Nat. Neurosci., 13(1):133-140, (2010) (author manuscript; available in PMC Jul. 1, 2010).

Maeder, M., and Gersbach, C., "Genome-editing Technologies for Gene and Cell Therapy," Molecular Therapy, vol. 24, No. 3, pp. 430-446, dated Mar. 2016, 17 pages.

Maeder, M., et al., "Robust, synergistic regulation of human gene expression using TALE activators," Nature Methods, vol. 10, No. 3, pp. 243-245, dated Mar. 2013, 9 pages.

Mahfouz, et al. "Targeted transcriptional repression using a chimeric TALE-SRDX repressor protein" Plant Mol Biol, 2012, 78:311-321.

Mahfouz, M., et al., "De novo-engineered transcription activator-like effector (TALE) hybrid nuclease with novel DNA binding specificity creates double-strand breaks," Proceedings of the National Academy of Science, vol. 108, No. 6, pp. 2623-2628, dated Feb. 8, 2011, 6 pages.

Mali et al., "CAS9 transcriptional activators for target specificity screening and paired nickases for cooperative genome engineering", Nature Biotechnology, Sep. 2013, vol. 31, No. 9, pp. 833-837.

Mali, et al, Supplementary Information for "Use of adjacent sgRNA: Cas9 complexes for transcriptional activation and genome engineering," Nature Biotechnology, doi:10.1037/nbt.2675.

Mali, et al.: "Supplementary Materials for—RNA-Guided Human Genome Engineering Via Cas9" Science, vol. 339, art. 6121, pp. 823-826, dated Feb. 15, 2013, 8 pages.

Mali, P., et al., "CAS9 transcriptional activators for target specificity screening and paired nickases for cooperative genome engineering," Nature Biotechnology, vol. 31, No. 9, pp. 833-838, dated Aug. 1, 2013, 8 pages.

Manjunath, N., et al., "Newer Gene Editing Technologies toward HIV Gene Therapy," Viruses, vol. 5, No. 11, pp. 2748-2766, dated Nov. 14, 2013, 19 pages.

*Manning v. Paradis*, 296 F.3d 1098 (Fed. Cir. 2012).

Marraffini, L., "CRISPR-Cas Immunity against Phages: Its Effects on the Evolution and Survival of Bacterial Pathogens," PLOS, Pathogens, dated Dec. 12, 2013, 6 pages.

Marraffini, L., Assignment to Rockefeller University, dated Dec. 12, 2013, 3 pages.

*Maxwell v. The Stanley Works*, 2006 WL 1967012, *5 (M.D. Tenn. Jul. 11, 2006).

Mincer, J., and Simon, S., "Simulations of nuclear pore transport yield mechanistic insights and quantitative predictions," Proceedings of the National Academy of Science, vol. 108, No. 31, pp. E351-E358, dated Aug. 2, 2011, 8 pages.

Mojica, F. J., et al., Supplementary Material for: "Short motif sequences determine the targets of the prokaryotic CRISPR defence system," Microbiology, vol. 155, No. 3, pp. 733-740, dated Mar. 1, 2009, 8 pages.

Morbitzer, et al. "Assembly of custom TALE-type DNA binding domains by modular cloning" 2011, 39(13):5790-5799.

Morbitzer, et al. "Regulation of selected genome loci using de novo-engineered transcription activator-like effector (TALE)-type transcription factors" PNAS, 2010, 108(50):21617-21622.

Morin, et al. "Nuclear Localization of the Adenovirus DNA-Binding Protein: Requirement for Two Signals and Complementation during Viral Infection" Molecular and Cellular Biology, 1989, 9(10):4372-4380.

Morris et al., "Distributed automated docking of flexible ligands to proteins: Parallel applications of AutoDock 2.4*", Journal of Computer-Aided Molecular Design, 1996, vol. 10, pp. 293-304.

Moscou, et al. "A Simple Cipher Governs DNA Regognition by TAL Effectors" Science, 2009, 326:1501.

Mussolino, et al. "TALE nucleases: tailored genome engineering made easy" Current Opinion in Biotechnology, 2012, 23(5):644-650.

Musunuru, "Abstract 18593: Use of a CRISPR/Cas System for Cardiovascular Disease Modeling and Therapeutic Applications", Circulation, vol. 128, No. 22, Suppl. 1, Nov. 26, 2013, 4 pages

(56) References Cited

OTHER PUBLICATIONS (Meeting info: American Heart Association, 2013 Scientific Sessions and Resuscitation Science Symposium, Dallas, TX, US, Nov. 16-20, 2013).
Muther, N., et al.: "Viral Hybrid Vectors for Somatic Integration—Are They the Better Solution?" Viruses, vol. 1, pp. 1295-1324, dated Dec. 15, 2009, 30 pages.
Nagarajan, et al. "A Hierarchy of Nuclear Localization Signals Governs the Import of the Regulatory Factor X Complex Subunits and MHC Class II Expression" The Journal of Immunology, 2004, 173:410.419.
Nakai, et al. "PSORT: a program for detecting sorting signals in proteins and predicting their subcellular localization" Trends in Biochem Sciences, 1999 24:34-35.
Noguchi, et al. "PDX-1 Protein Containing Its Own Antennapedia-Like Protein Transduction Domain Can Transduce Pancreatic Duct and Islet Cells" Diabetes, 2003, 52:1732-1737.
Notice of Opposition filed Aug. 11, 2017 by Schlich against EP Patent No. 2840140.
Notice of Opposition filed Aug. 14, 2017 by Grund against EP Patent No. 2840140.
Notice of Opposition filed Aug. 16, 2017 by Mathys & Squire LLP against EP Patent No. 2840140.
Notice of Opposition filed by Aug. 16, 2017 by Vossius against EP Patent No. 2840140.
O'Hare, et al. "Transformation of mouse fibroblasts to methotrexate resistance by a recombinant plasmid expressing a prokaryotic dihydrofolate reductase" Proc. Natl. Acad. Sci., 1981, 78(3):1527-1531.
Oost, "New Tool for Genome Surgery" Science, Feb. 15, 2013, 399:768-770.
Opposition Against Appl. Ser. No. EP13818570.7 submitted by Schlich dated Oct. 26, 2015, 8 pages.
Opposition Against EP Appl. Ser. No. 2771468-B1 dated Oct. 26, 2015.
Ozawa, K., "Gene therapy using AAV," Uirusu, vol. 57, No. 1, pp. 47-55, dated Nov. 27, 2007, 13 pages (with English Abstract; No English Translation).
Pandika, et al., www.ozy.com/rising-stars-and-provocateurs/jennifer-doudna-crispr-code-killer/4690; 2014 (Jul. 1, 2014).
Park, et al. "Regulation of Ribosomal S6 Kinase 2 by Mammalian Target of Rapamycin", The Journal of Biological Chemistry, 2002, 277(35):31423-31429.
Pattanayak, et al., "High-throughput profiling of off-target DNA cleavage reveals RNA-programmed Cas9 nuclease specificity," Nature Biotechnology, vol. 31, No. 9, pp. 839-843, dated 2013, including Supplementary Materials.
Perez-Pinera, et al. "Advances in Targeted Genome Editiong" Curr Opin Chem Biol., 2012, 16(3-4):268.277, doi:10.1016/j.cbpa.2012.06.007.
Phillips, A., "The challenge of gene therapy and DNA delivery," The Journal of Pharmacy and Pharmacology, vol. 53, pp. 1169-1174, dated 2001, 6 pages.
Planey, et al. "Mechanisms of Signal Transduction: Inhibition of Glucocorticoid-induced Apoptosis in 697 Pre-B Lymphocytes by the Mineralocorticoid Receptor N-terminal Domain", J. Biol. Chem., 2002, 277:42188-42196.
Porteus, M., and Balitmore, D., "Chimeric Nucleases Stimulate Gene Targeting in Human Cells," Science, vol. 300, p. 763, dated May 2, 2003, 2 pages.
Posfai, et al. "Markerless gene replacement in *Escherichia coli* stimulated by a double-strand break in the chromosome" Nucleic Acids Resarch, 1999, 27(22):4409-4415.
Pougach, K.S., et al.: "CRISPR Adaptive Immunity Systems of Prokaryotes," Molecular Biology, vol. 46, No. 2, Apr. 2012, pp. 195-203, 1 page (English Abstract).
PowerPoint slide entitled "Development and Applications of CRISPR-Cas9 for Genome Editing" dated Sep. 9, 2015.
Pride, D., et al., "Analysis of Streptococcal CRISPRs from Human Saliva Reveals Substantial Sequence Diversity Within and Between Subjects Over Time," Genome Research, vol. 21, No. 1, pp. 126-136, dated Jan. 2011, 11 pages.
Primo, et al. "Lentiviral vectors for cutaneous RNA managing" Experimental Dermatology, 2012, 21:162-170.
Qi, J., et al., "microRNAs regulate human embryonic stem cell division," Cell Cycle, vol. 8, No. 22, pp. 3729-3741, dated Nov. 15, 2009, 13 pages.
Radecke, S., et al., "Zinc-finger Nuclease-induced Gene Repair With Oligodeoxynucleotides: Wanted and Unwanted Target Locus Modifications," Molecular Therapy, vol. 18, No. 4, pp. 743-753, dated Apr. 2010, 11 pages.
Radulovich, et al. "Modified gateway system for double shRNA expression and Cre/lox based gene expression" BMC Biotechnology, 2011, 11(24):1-9.
Ran, et al., "Double Nicking by RNA-Guided CRISPR Cas9 for Enhanced Genome Editing Specificity," Cell 154, 1-10, Sep. 12, 2013.
Redeclaration—C.F.R. 41.203(c); filed Mar. 17, 2016.
Response to Third Party Observations in EP No. 13824232.6 filed Oct. 2, 2014, with Redlined and Clean Amended Claims.
Rho, M., et al., "Diverse CRISPRs Evolving in Human Microbiomes," PLOS Genetics, vol. 8, No. 6, pp. e1002441, dated Jun. 2012, 12 pages.
Rhun, A., and Charpentier, E., "Small RNAs in streptococci," RNA Biology, vol. 9, No. 4, pp. 414-426, dated Apr. 2012, 13 pages.
Roberts, et al. "Nuclear location signal-mediated protein transport" Biochimica et Biophysica Acta, 1989, 1008:263-280.
Roberts, et al. "The Effect of Protein Content on Nuclear Location Signal Function" Cell, 1987, 50:465-475.
Rockefeller University and Broad Institute of MIT and Harvard announce update to CRISPR-Cas9 portfolio filed by Broad, Press Release dated Jan. 15, 2018, retrieved from: https://www.broadinstitute.org/news/rockefeller-university-and-broad-institute-mit-and-harvard-announce-update-crispr-cas9, 3 pages.
Rodrigues, et al. "Red Fluorescent Protein (DsRed) as a Reporter in *Saccharomyces cerevisiae*" Journal of Bacteriology, 2001, 183(12):3791-3794.
Rodriguez et al., "AAV-CRISPR: A New Therapeutic Approach to Nucleotide Repeat Diseases", Molecular Therapy, vol. 22, Supplement 1, Abstract 247, May 2014, p. S94.
Rolling, "Recombinant AAV-mediated gene transfer to the retina: gene therapy perspectives", Gene Therapy, Vo. 11, 2004, pp. S26-S32.
*Rubin v. The General Hospital Corp.*, 2011-1439 (Fed. Cir. Mar. 28, 2013).
Sadowski, M., and Jones, D., "The sequence-structure relationship and protein function prediction," Current Opinion in Structural Biology, vol. 19, pp. 357-362, dated May 4, 2009, 6 pages.
Sambrook, et al., Molecular Cloning, A Laboratory Manual on the Web, 2001, Chapter 16.
Sander, et al., "CRISPR-Cas systems for editing, regulating and targeting genomes," Nature Biotechnology, vol. 32, pp. 347-355, dated 2014.
Sanders, UC Berkeley Jan. 7, 2013 Press Release, available at http://newscenter.berkeley.edu/2013/01/07/cheap-and-easy-technique-to-snip-dna-could-revolutionize-gene-therapy/.
Sanjana, et al., "Improved vectors and genome-wide libraries for CRISPR screening," HHS Public Access Author Manuscript, 2014, 11(8):2145-2148.
Sanjana, N., et al., "A Transcription Activator-Like Effector (TALE) Toolbox for Genome Engineering," Nature Protocols, vol. 7, No. 1, pp. 171-192, dated Jan. 1, 2012, 39 pages.
Sato, et al. "Generation of Adeno-Associated Virus Vector Enabling Functional Expression of Oxytocin Receptor and Fluorescence Marker Genes Using the Human elF4G Internal Ribosome Entry Site Elemet" Biosci. Biotechno. Biochem, 2009, 73(9):2145-2148.
Sebastiani, et al., "BCL11A enhancer haplotypes and fetal hemoglobin in sickle cell anemia," Blood Cells, vol. 54, No. 3, pp. 1079-9796, dated 2015.
Sebo, et al. "A simplified and efficient germline-specific CRISPR/Cas9 system for *Drosophila* genomic engineering" Fly, 2014, 8(1):52-57.

(56) References Cited

OTHER PUBLICATIONS

Seffernick, J., et al., "Melamine Deaminase and Atrazine Chlorohydrolase: 98 Percent Identical but Functionally Different," Journal of Bacteriology, vol. 183, No. 8, pp. 2405-2410, dated Apr. 2001, 6 pages.
Senis, E., et al., "CRISPR/Cas9-mediated genome engineering: An adeno-associated viral (AAV) vector toolbox," Biotechnology Journal, vol. 9, No. 11, Sp. Iss. SI, pp. 1402-1412, dated Sep. 4, 2014, 12 pages.
Senturk et al., "A rapid and tunable method to temporally control cas9 expression enables the identification of essential genes and the interrogation of functional gene interactions in vitro and in vivo", Jul. 28, 2015, pp. 1-27, XP002756303, doi:10.1101/023366, Retrieved from the Internet: URL:http://biorxiv.org/content/early/2015/07/28/023366 [retrieved on Apr. 11, 2016).
Shalem, et al., "High-throughput functional genomics using CRISP-Cas9," Nature Reviews Genetics, vol. 16, No. 5, pp. 1471-0056, dated 2015.
Sharan, et al. "Recombineering: A Homologous Recombination-Based Method of Genetic Engineering" Nat. Protoc., 2009, 4(2):206-223, doi:10.1038/nprot.2008.227.
Shengdar Tsai et al., "Dimeric CRISPR RNS-guided FokI nucleases for highly specific genome editing", Nature Biotechnology, vol. 32, No. 6, Apr. 25, 2014, pp. 569-576.
Shieh, et al. "Nuclear Targeting of the Maize R. Protein Requires Two Nuclear Localization Sequences" Plant Physiol, 1993, 101:353-361.
Siegl, et al. "I-SceI endonuclease: a new tool for DNA repair studies and genetic manipulations in streptomycetes" Appl Microbiol Bitotechnol, 2010, 87:1525-1532.
Singer, et al. "Applications of Lentiviral Vectors for shRNA Delivery and Transgenesis" Curr Gene Ther., 2008, 8(6):483-488.
Slaymaker et al., Rationally engineered Cas9 nucleases with improved specificity, Science, American Association for the Advancement of Science, US, vol. 351, No. 6268, Jan. 1, 2016, pp. 84-88.
Stoller, J. and Aboussouan, L., "Alpha1-antitrypsin deficiency," The Lancet, Seminar, vol. 365, No. 9478, pp. 2225-2236, dated Jun. 25, 2005, 12 pages.
Stratikopoulos, E., et al., "The hormonal action of IGF1 in postnatal mouse growth," Proceedings of the National Academy of Sciences, vol. 105, No. 49, pp. 19378-19383, dated Dec. 9, 2008, 6 pages.
Straub, C., et al., "CRISPR/Cas9-Mediated Gene Knock-Down in Post-Mitotic Neurons," PLOS One, vol. 9, No. 8, art. E105584, pp. 1-5, dated Aug. 2014, 6 pages.
Sung, et al. "An rpsL Cassette, Janus, for Gene Replacement through Negative Selectionin *Streptococcus pneumoniae*" Applied and Environmental Microbiology, 2001, 67(11):5190-5196.
Sung, M., et al., "The importance of valency in enhancing the import and cell routing potential of protein transduction domain-containing molecules," Biochimica et Biophysica Aeta, vol. 1758, pp. 355-363, dated 2006, 9 pages.
Sung, Young Hoon, et al. "Mouse genetics: Catalogue and scissors" BMB Reports, 2012, 45(12):686-692.
Suzuki, K., et al., "In vivo genome editing via CRISPR/Cas9 mediated homology-independent targeted integration," Nature, vol. 540, art. 7631, pp. 144-149, dated Dec. 1, 2016, 44 pages.
Swarthout, J., et al., "Zinc Finger Nucleases: A new era for transgenic animals," Annals of Neurosciences, vol. 18, No. 1, pp. 25-28, dated Jan. 2011, 4 pages.
Swiech et al., "CRISPR-Mediated Genome Editing in the Mammalian Brain", Molecular Therapy, vol. 22, 749, May 2012, p. S289.
Tang, T., et al., "A mouse knockout library for secreted and transmembrane proteins," Nature Biotechnology, vol. 28, No. 7, pp. 749-755, dated Jul. 2010, 9 pages.
*The Broad Inst. v. The Regents of University of UCA*—Decision on Motions for Patent Interference No. 106,048 filed Feb. 15, 2017.
Third Party Observation for Application No. EP20130824232 filed Sep. 22, 2014.
Third Party Observations Concerning App. No. GB1420270.9 dated Jun. 30, 2015.
Third Party Observations Concerning Appl. No. EP2800811, dated Jul. 24, 2015.
Third Party Observations Concerning Appl. No. EP2800811, dated Sep. 4, 2015.
Third Party Observations Concerning Appl. No. GB1420270.9 dated Jun. 30, 2015.
Third Party Observations Concerning Appl. No. GB1420270.9, dated Jul. 13, 2015.
Third Party Observations in Accordance with Article 115 EPC, Appl. No. EP13824232.6, Pub. No. EP2764103A, Mar. 25, 2015.
Third Party Observations submitted by Broad Institute Inc. Concerning Appl. Ser. No. EP13793997.1 dated Jul. 24, 2015, 108 pages.
Third Party Observations submitted by Broad Institute Inc. Concerning Appl. Ser. No. EP13793997.1 dated Sep. 4, 2015, 25 pages.
Third Party Observations submitted by Regents of the University of California et al. Concerning App. No. GB1420270.9 dated Jul. 13, 2015, 18 pages.
Third Party-Observations, Appl. No. 1382432.6, Pub. No. EP2764103, Feb. 16, 2015.
Third-Party Observation for Application No. EP20130824232 Aug. 9, 2014.
Tinland, et al. "The T-DNA-linked VirD2 protein contains two distinct functional nuclear localization signals" Proc. Natl. Acad. Sci, 1992, 89:7442-7446.
Tiscornia, et al. "Development of Lentiviral Vectors Expressing siRNA" Gene Transfer-Delivery and Expression of DNA and RNA—A Laboratory Manual, 2007, Chapter 3:23-34.
Trafton, A., "CRISPR-carrying nanoparticles edit the genome," MIT News, dated Nov. 13, 2017, 3 pages.
Tulpan, D., et al., "Free energy estimation of short DNA duplex hybridizations," BMC Bioinformatics, vol. 11, pp. 105-127, dated 2012, 22 pages.
Type V CRISPR-associated protein Cpf1 [*Acidaminococcus* sp. Bv3L6], 2017, NCBI Reference Sequence: WP_02173622.1, Non-redundant Protein Sequence.
*Ultra-Precision Mfg. Ltd. v. Ford Motor Co.*, 2004 WL 3507671, *7, *11-12 (E.D. Mich. Mar. 30, 2004).
Urnov, F., et al., "Genome editing with engineered zinc finger nucleases," Nature Reviews, Genetics, vol. 11, pp. 637-646, dated Sep. 2010, 11 pages.
Urrutia, et al. "KRAB-containing zing finger repressor proteins" Genome Biology, 2003, 4(10):231-231.8.
Van Den Ackerveken, et al. "Recognition of the Bacterial Avirulence Protein AvrBs3 Occurs inside the Host Plant Cell" Cell, 1996, 87:1307-1316.
Van Nierop, G., et al., "Stimulation of homology-directed gene targeting at an endogenous human locus by a nicking endonuclease," Nucleic Acids Research, vol. 37, No. 17, pp. 5725-5736, dated Aug. 3, 2009, 12 pages.
Venken et al., "P[acman]: A BAC Transgenic Platform for Targeted Insertion of Large DNA Fragments in *D. melanogaster*", Science, vol. 314, No. 5806, Nov. 30, 2006, pp. 1747-1751.
Villion, et al. "The double-edged sword of CRISPR-Cas systems" Cell Research, 2013, 23:15-17.
Wang, et al. "Genetic Screens in Human Cells Using the CRISPR-Cas9 System", Science, 2014, 343:80-84.
Weber et al., "TALENs Targeting HBV: Designer Endonuclease Therapies for Viral Infections", Molecular Therapy, vol. 21, No. 10, Oct. 2013, pp. 1819-1821.
Welch, et al. "Designing Genes for Successful Protein Expression" Methods in Enzymology, 2011, 498:43-66, DOI: 10.1016/6978-0-12-385120-8.00003-6.
Wienert, B., et al., "In vitro transcribed guide RNAs trigger an innate immune response via the RIG-I pathway," BioRxiv Preprint, dated Mar. 3, 2018, 28 pages.
Witkowski, A., et al., "Conversion of a Beta-Ketoacyl Synthase to a Malonyl Decarboxylase by Replacement of the Active-Site Cysteine with Glutamine," Biochemistry, vol. 38, pp. 11643-11650, dated Aug. 18, 1999, 8 pages.
Wittmann et al., "Engineered riboswitches: Expanding researchers' toolbox with synthetic RNA regulators", FEBS Letters, vol. 586, No. 15, Feb. 28, 2012, pp. 2076-2083.

(56) References Cited

OTHER PUBLICATIONS

Wolff, et al. "Nuclear security breached" Nature Biotechnology, 2001, 19:1118-1120.
Wu, Y., et al., "Correction of a Genetic Disease in Mouse via Use of CRISPR-Cas9," Cell Stem Cell, vol. 13, No. 6, pp. 659-662, dated Dec. 5, 2013, 4 pages.
Wu, Z., et al., "Effect of Genome Size on AAV Vector Packaging," The American Society of Gene & Cell Therapy, vol. 18, No. 1, pp. 80-86, dated Jan. 2010, 7 pages.
Xie, et al. "RNA-Guided Genome Editing in Plants Using a CRISPR-Cas System" Molecular Plant, 2013, 6(6):1975-1983.
Yaghmai, et al. "Optimized Regulation of Gene Expression Using Artificial Transcription Factors", Molecular Therapy, 2002, 5(6):685-694.
Yamano, et al. "Crystal Structure of Cpf1 in Complex with Guide RNA and Target DNA" Cell, 2016, 165:949-962.
Yanfang Fu et al., "Improving CRISPR-Cas nuclease specificity using truncated guide RNAs" (with Supplement Table), Nature Biotechnology, vol. 32, No. 3, Jan. 26, 2014, pp. 279-284.
Yang et al., "HIV-1 TAT-mediated protein transduction and subcellular localization using novel expression vectors," FEBS Letters 532:36-44, (2002).
Yang, H., et al., "One-Step Generation of Mice Carrying Reporter and Conditional Alleles by CRISPR/Cas-Mediated Genome Engineering," Cell, vol. 154, No. 6, pp. 1370-1379, dated Sep. 12, 2013, 14 pages.
Yi, et al. "Current Advances in Retroviral Gene Therapy" Current Gene Therapy, 2011, 11:218:228.
Yin, H., et al., "Structure-guided chemical modification of guide RNA enables potent non-viral in vivo genome editing," Nature Biotechnology, vol. 35, pp. 1179-1187, dated Nov. 13, 2017, 22 pages.
Yu, et al. "An efficient recombination system for chromosome engineering in *Escherichia coli*" PNAS, 2000, 97(11):5978-5983.
Yu, W., et al., "Nrl knockdown by AAV-delivered CRISPR/Cas9 prevents retinal degeneration in mice," Nature Communications, vol. 8, art. 14716, dated Mar. 14, 2017, 15 pages.
Yu, Zhongshen, et al. "Highly Efficient Genome Modifications Mediated by CRISPR/Cas9 in *Drosophila*" Genetics, 2013, 195:289-291.
Yusuke Miyazaki et al., Destabilizing Domains Derived from the Human Estrogen Receptor:, Journal of the American Chemical Society, vol. 134, No. 9, Mar. 7, 2012, pp. 3942-3945.
Zhang, "Processing-Independent CRISPR RNAs Limit Natural Transformation in Neisseria meningitidis", Molecular Cell, vol. 50, May 23, 2013. pp. 488-503.
Zhang, et al. "Optogenetic interrogation of neural circuits: technology for probing mammalian brain structures" Nat Protoc., 2010, 5(3):439-456, doi:10.1038/nprot.2009.226.
Zhang, et al. "Optimized CRISPR Design", MIT, XP055167487, Oct. 23, 2013, URL:http//crispr.mit.edu/about[retrieved on Feb. 5, 2015].
Zhang, F., PowerPoint Presentation: "Development and Applications of CRISPR-Cas9 for Genome Editing," Broad Institute/MIT, dated Sep. 9, 2015, 50 pages.
Zhang, L., et al., "Efficient Expression of CFTR Function with Adeno-Associated Virus Vectors that Carry Shortened CFTR Genes," Proceedings of the National Academy of Science USA, vol. 95, pp. 10158-10163, dated Aug. 1998, 6 pages.
Zhou, et al., "High-throughput screening of a CRISPR/Cas9 library for functional genomics in human cells," Nature, vol. 509, pp. 487-491, dated 2014.
Zolkiewska, et al. "ADAM Proteases:Ligand Processing and Modulation of the Notch Pathway" Cell Mol Life Sci, 2008, 65(13):2056-2068.
Zuris, et al., "Cationic lipid-mediated delivery of proteins enables efficient protein-based genome editing in vitro and in vivo" Nature Biotechnology, 2014, Advanced Online publication, doi:10.1038/nbt.3081.
Zuris, et al., Supplementary Information—"Cationic lipid-mediated delivery proteins enables efficient protein-based genome editing in vitro and in vivo" Nature Biotechnology, 2014, Advanced Online publication, doi:10.1038/nbt.3081.
Nishimasu et al., "Crystal Structure of Cas9 in Complex with Guide RNA and Target DNA," Cell, 156:935-949; (2014).†

\* cited by examiner
† cited by third party

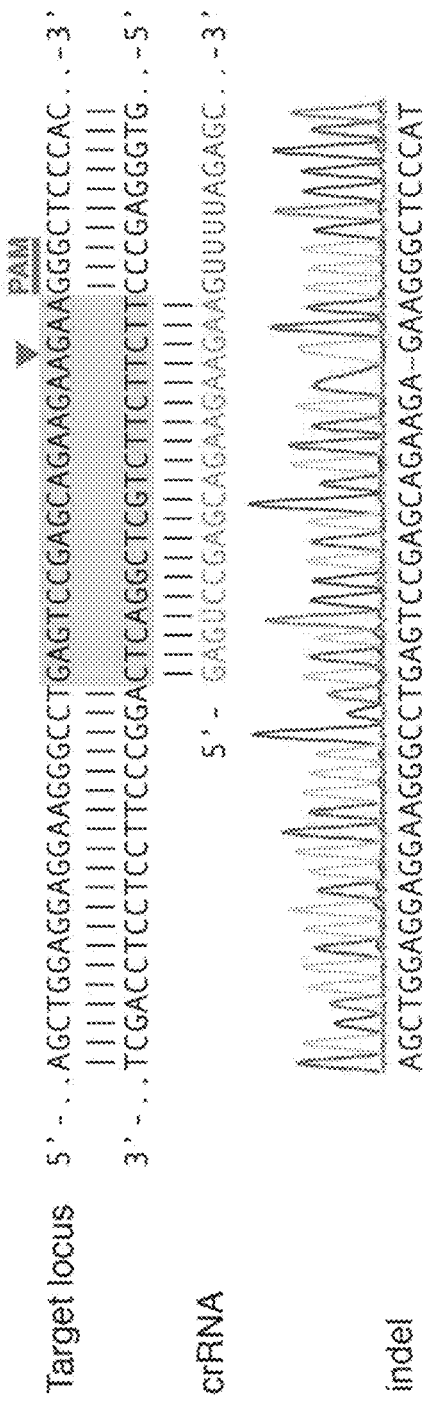

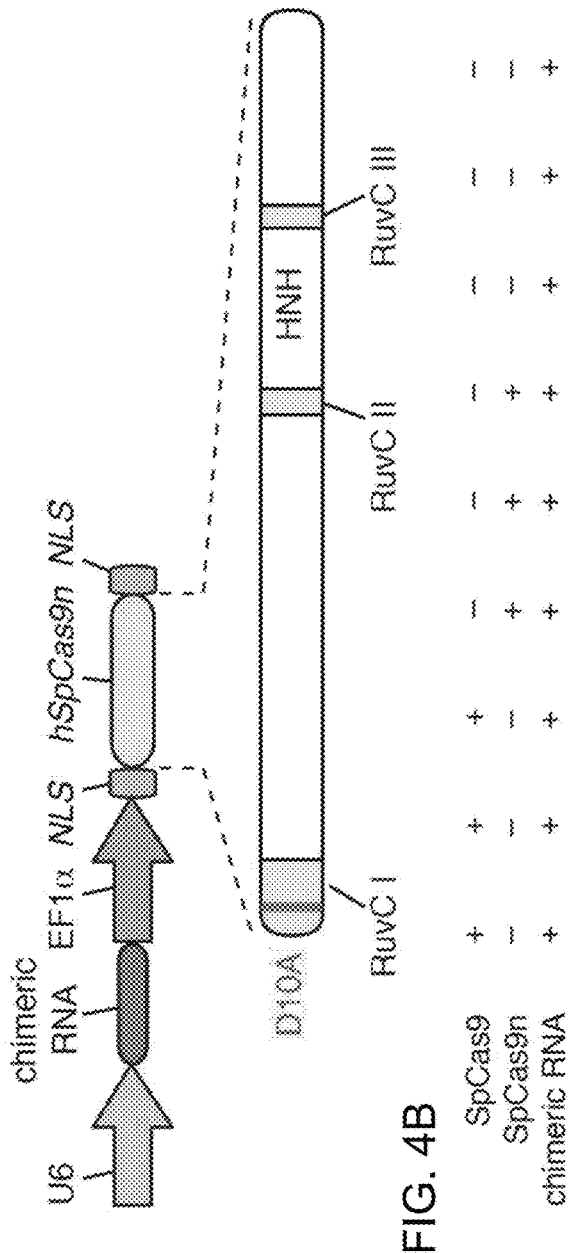
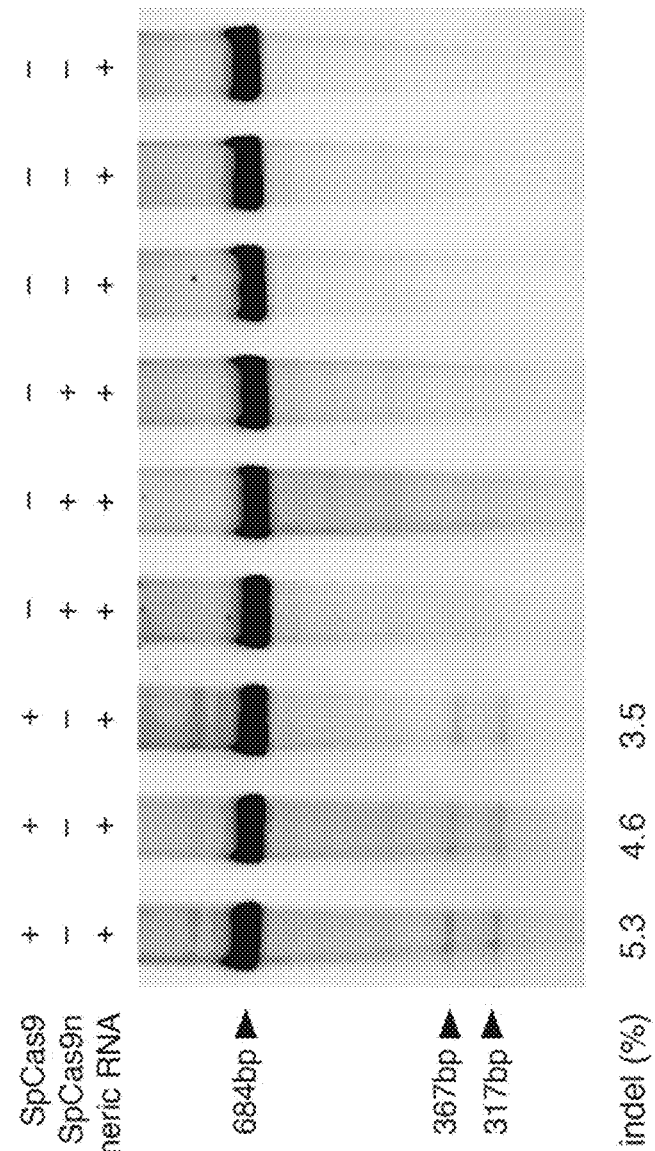
FIG. 4A
FIG. 4B

| Cas9 | target species | gene | protospacer ID | protospacer sequence (5' to 3') | PAM | strand | cell line tested | % indel (pre-crRNA + tracrRNA) | % indel (chimeric RNA) |
|---|---|---|---|---|---|---|---|---|---|
| S. pyogenes SF370 type II CRISPR | Homo sapiens | EMX1 | 1 | GGAGGGCCTGAGTCCGAGCAGAAGAAGAA | GGG | + | 293FT | 20 ± 1.8 | 6.7 ± 0.62 |
| | | EMX1 | 2 | CATTGGAGGTGACATCGATGTCCTCCCCAT | TGG | – | 293FT | 2.1 ± 0.31 | N.D. |
| | | EMX1 | 3 | GGACATCGATGTCACCTCCAATGACTAGGG | TGG | + | 293FT | 14 ± 1.1 | N.D. |
| | | EMX1 | 4 | CATGGATCTCCCCATTGGCCTGCTTG | TGG | – | 293FT | 11 ± 1.7 | N.D. |
| | | EMX1 | 5 | TTCGTGGCAATGCGCCACCGGTTGATGTGA | TGG | – | 293FT | 4.3 ± 0.46 | 2.1 ± 0.51 |
| | | EMX1 | 6 | TCGTGGCAATGCGCCACCGGTTGATGTGAT | TGG | – | 293FT | 4.0 ± 0.86 | 0.41 ± 0.25 |
| | | EMX1 | 7 | TCCAGCTTCTGCCGTTTGTACTTTGTCCTC | CGG | – | 293FT | 1.5 ± 0.12 | N.D. |
| | | EMX1 | 8 | GGAGGACAAAGTACAAACGGCAGAAGCTGG | AGG | – | 293FT | 7.8 ± 0.83 | 2.3 ± 1.2 |
| | Homo sapiens | PVALB | 9 | AGGGCCCGAGATTGGGTGTTCAGGGCAGAG | AGG | + | 293FT | 21 ± 2.6 | 6.5 ± 0.32 |
| | | PVALB | 10 | ATCAGAGAGGGTGGCGAGAGGGCCCGAGAT | TGG | + | 293FT | N.D. | N.D. |
| | | PVALB | 11 | GGTGGCGAGAGGGCCCGAGATTGGGTGTTC | AGG | + | 293FT | N.D. | N.D. |
| | Mus musculus | Th | 12 | CAAGCACTGAGTCGCCATTAGTCTAAATGAT | AGG | – | Neuro2A | 2.7 ± 4.3 | 4.1 ± 2.2 |
| | | Th | 13 | AATGCATAGGGTACCACCCAGTGCCAG | GGG | – | Neuro2A | 4.8 ± 1.2 | N.D. |
| | | Th | 14 | ACACACATGGGAAAGCCCTCGGGCCAGAA | AGG | + | Neuro2A | 11.3 ± 1.3 | N.D. |
| S. thermophilus LMD-9 CRISPR1 | Homo sapiens | EMX1 | 15 | GGAGCAGGTAGTATACAAACACAGAGAA | GTAGAAT | – | 293FT | 14 ± 0.88 | N.T. |
| | | EMX1 | 16 | AGAATGTACAGAGTCACGAAACTCAGCA | CTAGAAA | – | 293FT | 7.8 ± 0.77 | N.T. |

FIG. 5

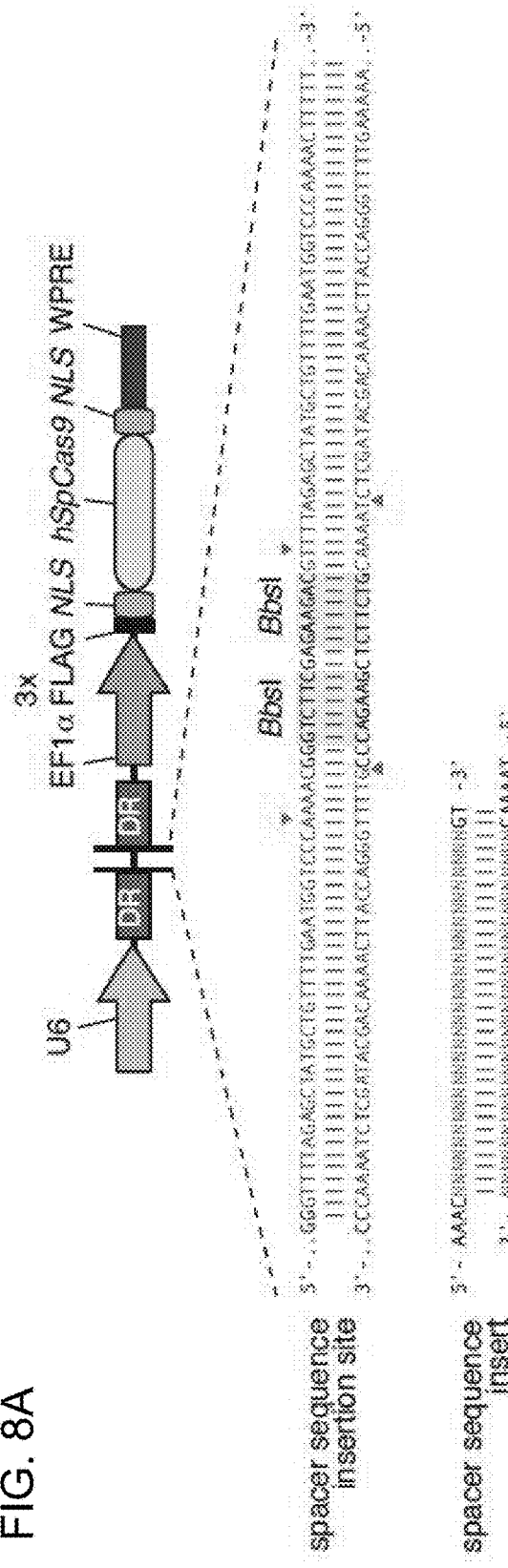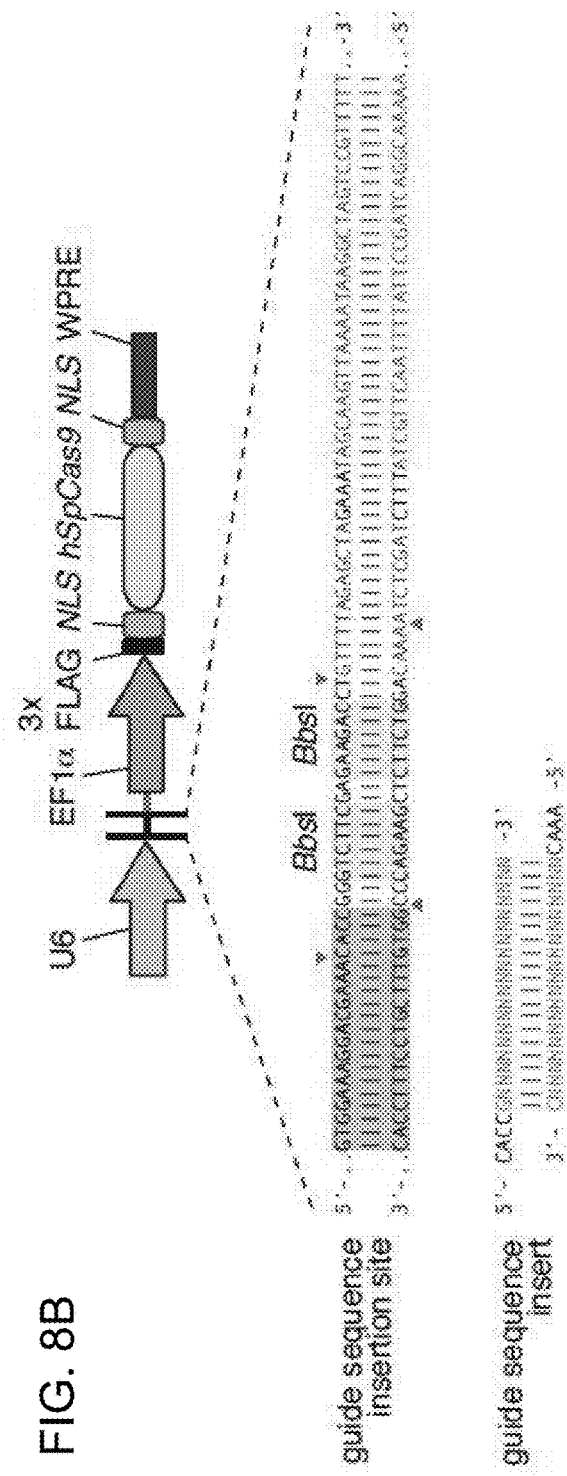
FIG. 8A
FIG. 8B

FIG. 9C
| Chr | NGG median | NGG mean | NNAGAAW median | NNAGAAW mean |
|---|---|---|---|---|
| 1 | 7 | 12.8 | 67 | 115.8 |
| 2 | 8 | 12.7 | 64 | 100.8 |
| 3 | 8 | 13.0 | 63 | 98.5 |
| 4 | 9 | 14.0 | 61 | 94.5 |
| 5 | 8 | 13.1 | 63 | 97.9 |
| 6 | 8 | 13.1 | 63 | 98.5 |
| 7 | 8 | 12.4 | 64 | 102.9 |
| 8 | 8 | 12.8 | 64 | 100.9 |
| 9 | 7 | 13.9 | 65 | 120.5 |
| 10 | 7 | 12.1 | 66 | 107.0 |
| 11 | 7 | 12.0 | 65 | 105.8 |
| 12 | 8 | 12.4 | 65 | 103.5 |
| 13 | 8 | 13.6 | 62 | 94.6 |
| 14 | 8 | 12.0 | 65 | 101.5 |
| 15 | 7 | 11.5 | 68 | 107.7 |
| 16 | 7 | 11.7 | 74 | 136.8 |
| 17 | 6 | 10.3 | 76 | 127.9 |
| 18 | 8 | 13.4 | 63 | 101.8 |
| 19 | 6 | 9.4 | 82 | 145.4 |
| 20 | 7 | 11.1 | 72 | 121.8 |
| 21 | 7 | 13.4 | 64 | 111.4 |
| 22 | 6 | 9.2 | 85 | 140.3 |
| X | 8 | 13.2 | 63 | 99.0 |
| Y | 8 | 29.2 | 62 | 223.7 |
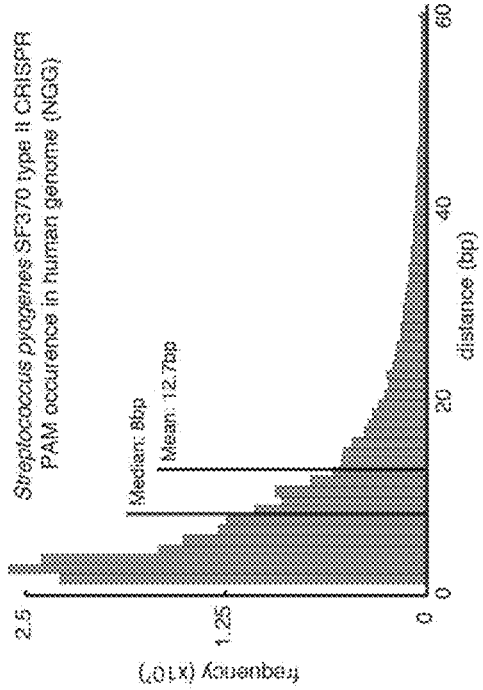
FIG. 9A
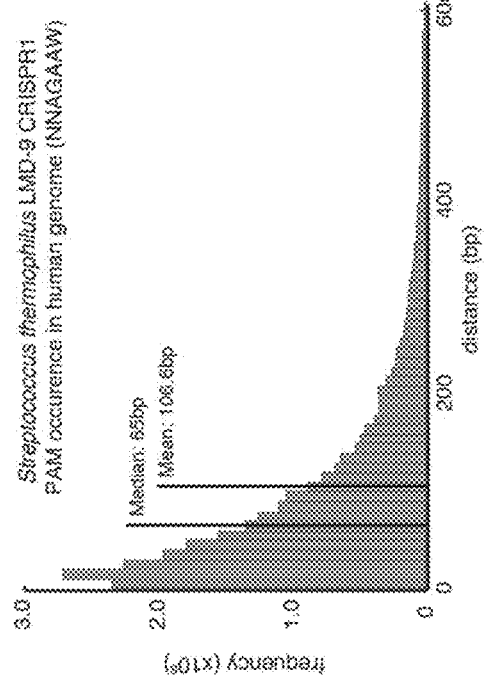
FIG. 9B
FIG. 9A-C

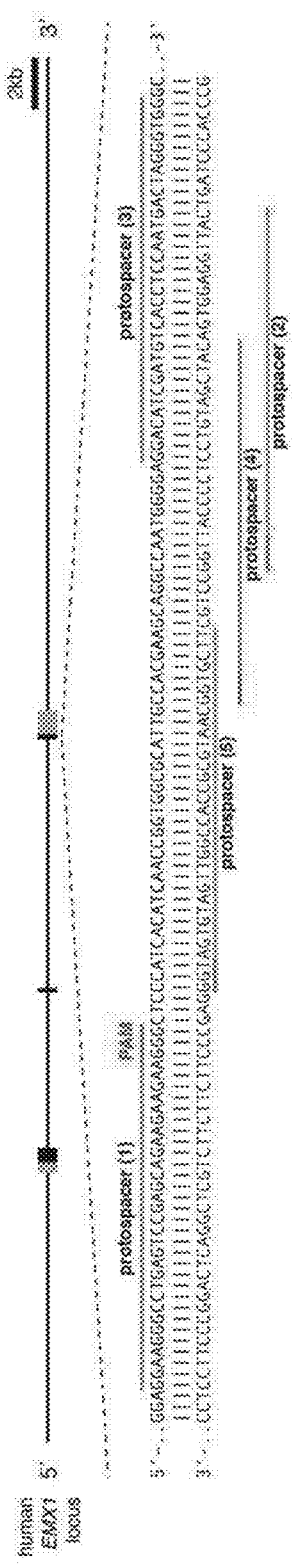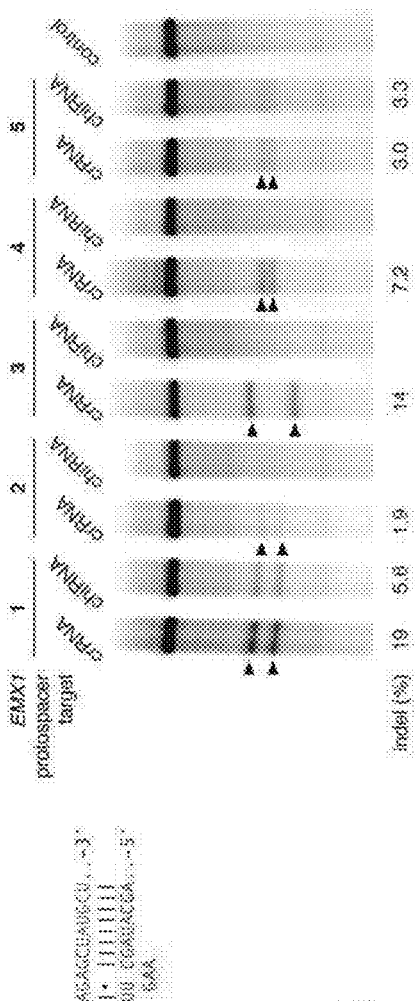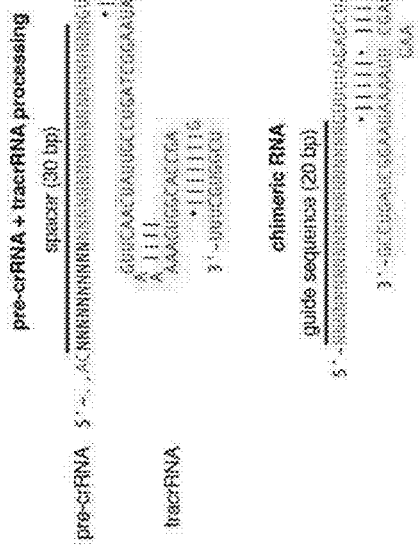
FIG. 11A
FIG. 11B
FIG. 11C
FIG. 11A-C

| Primer name | Assay | Genomic Target | Primer sequence |
|---|---|---|---|
| Sp-EMX1-F | SURVEYOR assay, sequencing | EMX1 | AAAACCACCCTTCTCTCTGGC |
| Sp-EMX1-R | SURVEYOR assay, sequencing | EMX1 | GGAGATTGGAGACACGGAGAG |
| Sp-PVALB-F | SURVEYOR assay, sequencing | PVALB | CTGGAAAGCCAATGCCTGAC |
| Sp-PVALB-R | SURVEYOR assay, sequencing | PVALB | GGCAGCAAACTCCTTGTCCT |
| Sp-Th-F | SURVEYOR assay, sequencing | Th | GTGCTTTGCAGAGGCCTACC |
| Sp-Th-R | SURVEYOR assay, sequencing | Th | CCTGGAGCGCATGCAGTAGT |
| St-EMX1-F | SURVEYOR assay, sequencing | EMX1 | ACCTTCTGTGTTTCCACCATTC |
| St-EMX1-R | SURVEYOR assay, sequencing | EMX1 | TTGGGGAGTGCACAGACTTC |
| Sp-EMX1-RFLP-F | RFLP, sequencing | EMX1 | GGCTCCCTGGGTTCAAAGTA |
| Sp-EMX1-RFLP-R | RFLP, sequencing | EMX1 | AGAGGGGTCTGGATGTCGTAA |
| Pb_EMX1_sp1 | Northern Blot Probe | Not applicable | TAGCTCTAAAACTTCTTCTTCTGCTCGGAC |
| Pb_tracrRNA | Northern Blot Probe | Not applicable | CTAGCCTTATTTTAACTTGCTATGCTGTTT |

| 1 | Sp_Δ_hel 1(87-173) |
|---|---|
| 2 | Sp_Δ_hel 1(87-102) |
| 3 | Sp_Δ_hel 1(103-121) |
| 4 | Sp_Δ_hel 1(122-134) |
| 5 | Sp_Δ_hel 1(135-173) |
| 6 | Sp_Δ_hel 2(174-311) |
| 7 | Sp_Δ_hel 2-(GGGGS)3 |
| 8 | Sp_Δ_hel 2-(GGGGS)6 |
| 9 | Sp_Δ_hel 2-(GGGGS)9 |
| 11 | Sp_Δ_hel 2-A(EAAAK)3A |
| 12 | Sp_Δ_hel 2-A(EAAAK)6A |
| 13 | Sp_Δ_hel 2-A(EAAAK)9A |
| 14 | Sp_Δ_hel 2-A(EAAAK)12A |
| 15 | Sp_Δ_hel 2(174-182) |
| 16 | Sp_Δ_hel 2(183-190) |
| 17 | Sp_Δ_hel 2(191-219) |

| 30 | Sp_Δ(175-307) |
|---|---|
| 31 | Sp_Δ(1098-1368) |
| 36 | Sp_Δ(175-307)-A(EAAAK)3A |
| 37 | Sp_Δ(175-307)-A(EAAAK)6A |

| 33 | Sp_Δ(175-307)-(GGGGS)6 |
|---|---|
| 35 | Sp_Δ(175-307)-(GGGGS)12 |

FIG. 30A
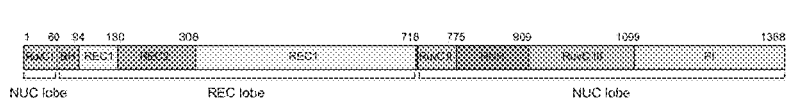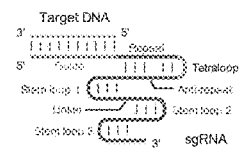
FIG. 30B
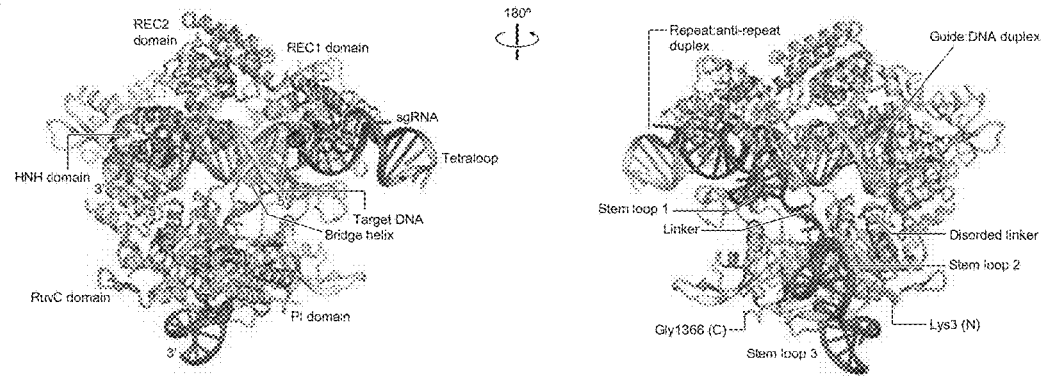
FIG. 30C
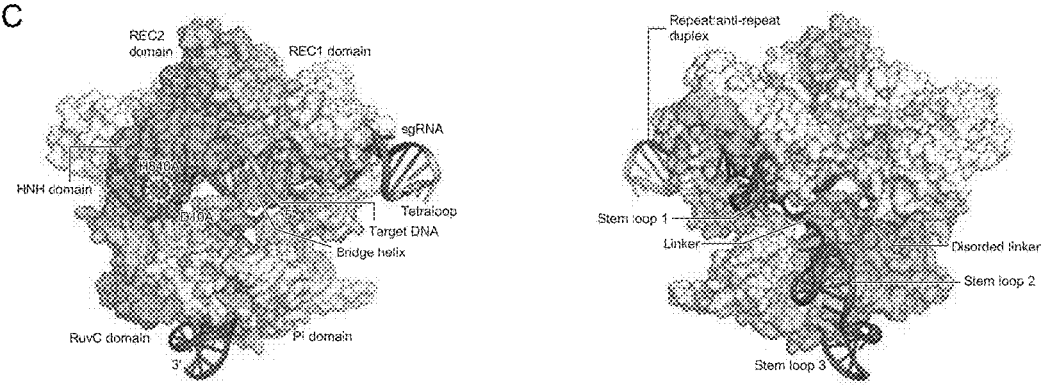
FIG. 30D
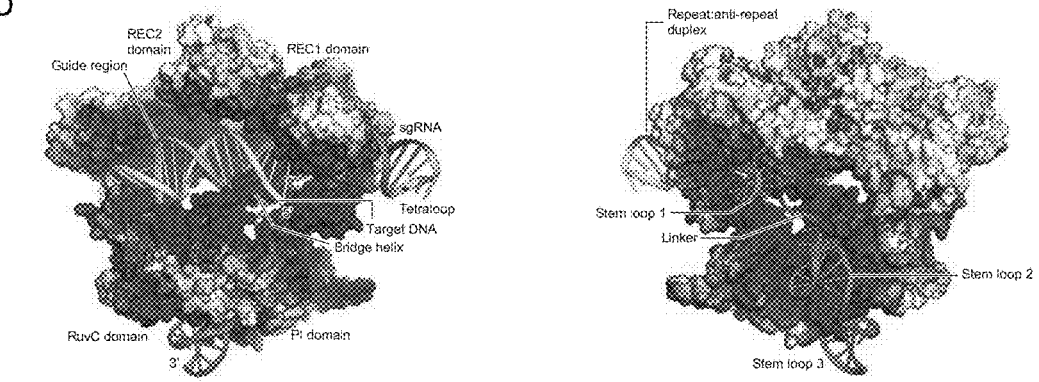

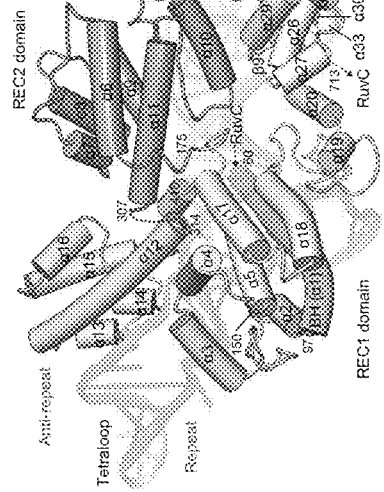

FIG. 34B  FIG. 34C  FIG. 34D
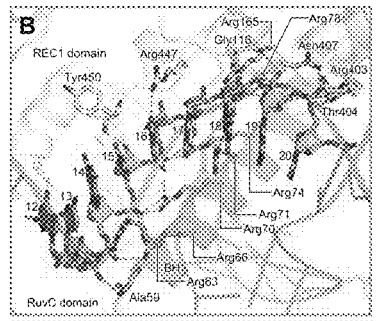 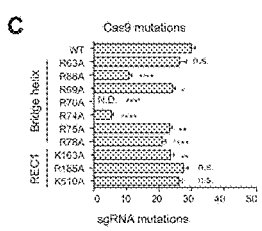 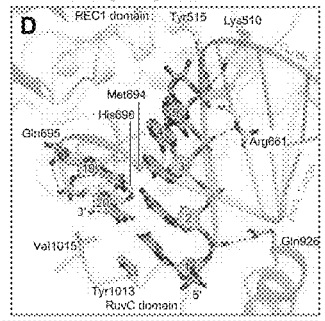
FIG. 34E 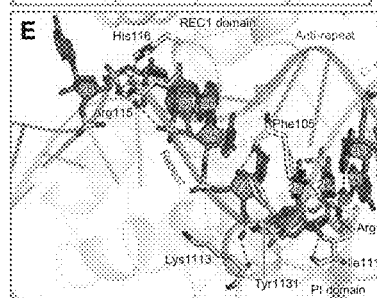 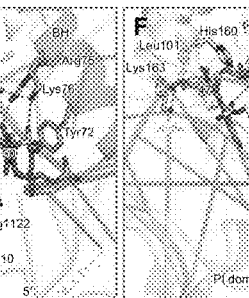 FIG. 34F
FIG. 34G 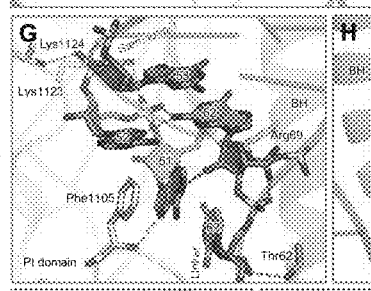 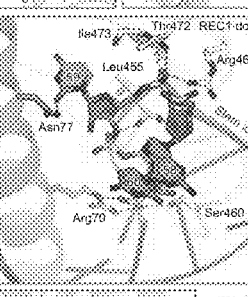 FIG. 34I
FIG. 34J 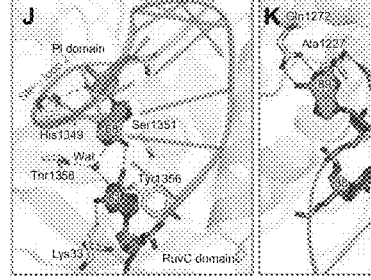 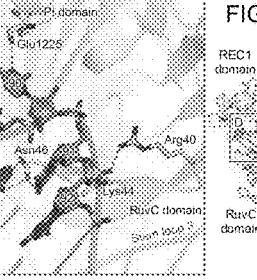
FIG. 34K FIG. 35A
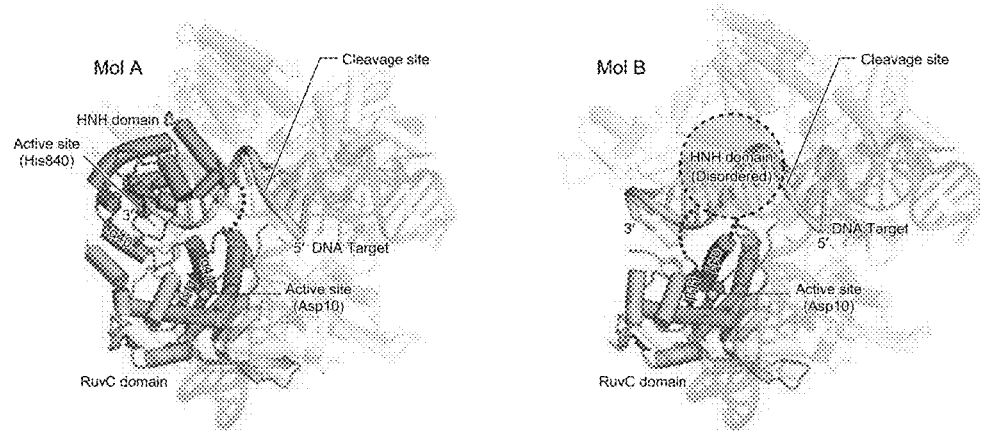
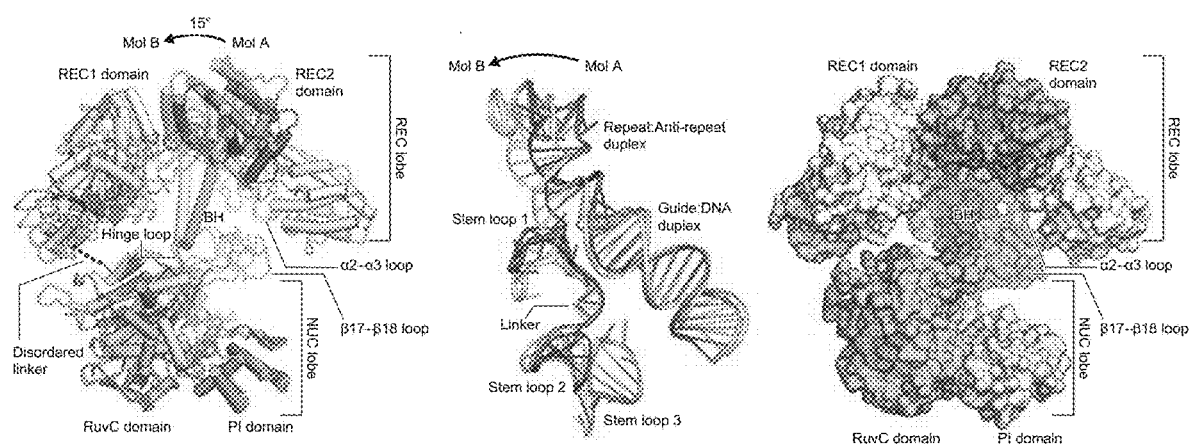
FIG. 35B         FIG. 35C         FIG. 35D FIG. 38A
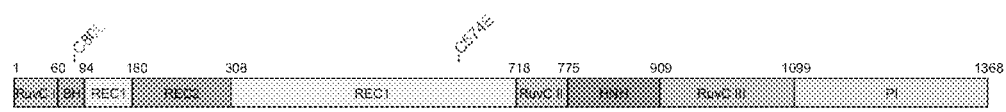
FIG. 38B
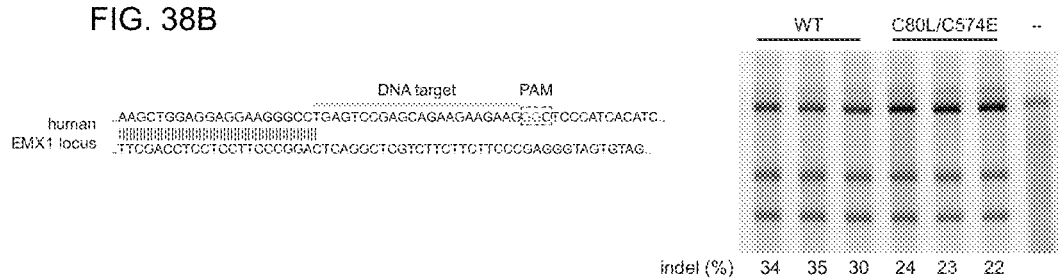
FIG. 38C

```
              β15       β16      α46        β17         P1
         1050      1060      1070      1080      1090      1100         1110      1120      1130
    Sp   ITLANGEIRKRPLIETNGETGEIVWDKGRDFATVRKVLSMPQVNIVKKTEVQTGGFSKE.........SILPKRNSDKLIARKKD...WDPKKYGGFDS
    Sm   DVRTD........KNGEIIWKKDEHISNIKKVLSYPQVNIVKKVEEQTGGFSKE.........SILPKGNSDKLIPRKTKKFYWDTKKYGGFDS
    St3  ISLADGRVIERPLIEVNEETGESVWNKESDLATVRRVLSYPQVNVVKKVEEQNHGLDRGKPKGLFNANLSSKPKPNSNENLVGAKEY..LDPKKYGGYAG
    St1  LKSKE........FEDSILFSYQVDSKFNRKISDATIYATRGAKVGKDKADETYVLGKIK.........DIYTQDGYDAFMKIYKE....DKSKFLMYRH
    Cj   .............FSGFRQKVLDKIDEIFVSKPERK.................................KPSGALNEETERKK....EEEFYQSYGG
    Mm   EKNNIKFKEKASFDNFLLINALDELNEKLNQMRFSRMVITKKNTQLFNETLYSGKYDEGK.........NTIKKVEKLNLLDNRTDKIKKIEEFFDEDKL

β18        β19       α47    α48      η8  β20       β21 η9 β22            β23
         1140      1150      1160      1170      1180      1190      1200      1210      1220
    Sp   PTVAYSVLVVAKVEKGKSKKLKSVKELLGYTIMERSSFEKNPIDELEAKGYKEVKKDLYYKLPKYS....LFELENGRKRMLASAG.......ELQKGNE
    Sm   PIVAYSILVIADIEKGKSKKLKTVKALVGVTIMEKMTFERDPVAFLERKGYRNVQEENYYKLPKYS....LFKLENGRKRLLASAR.......ELQKGNE
    St3  ISNSFTVLYKGTIEKGAKKKITNVLEFQGISILDRINYRKDKLNFLLEKGYKDI..ELIIELPKYS....LPELSDGSRRMLASILSTNNKRGEIHKGNQ
    St1  DPQTFEKVIEPILSNYPNKQINEKGKEYPCNPFLKYKEEHGYIRKYSKAGNGPEIKSLYYDSKLGNHIDITPKDSNNKVVLQSVSPWR....ADVYFNK
    Cj   KEGVLKALELGKIRKVNGKIVKNGDMFRVDIFKHKKTNKFYAVPIYTMDFALKVLPNKAVARSKKG..............EIKDWIL
    Mm   KENELTKLHIFNHDKNLYETLKIIWNEVKIETKNKNLNEKNYFKYFVNKKLQEGKISFNEWVFILDN...........DFKIIRKIR......YIKFSSE

α49           α50           α51          α52           α53         η10
         1230      1240      1250      1260      1270      1280      1290      1300      1310
    Sp   LALPSKYVNFLYLASHYEKLKGSPEDNEQKQLFVEQHKHYLDEIIEQISEPSKRVILADANLDKVLSAYNKHRDKPTREQAENIIH........LFTLTN
    Sm   IVLPNHLGTLLYHAKNIHKV.....DEPKHLDYVDKHKDEFKELLDVVSNFSKKYTLAEGNLEKIKELYAQNNGEDLKELASSFIN........LLTFTA
    St3  IFLSQKFVKLLYHAKRISNT.....INENNHRKYVENHKKEFEELFYYILEFNENYVGAKKNGKLLNSAFQSWQNHSIDELCSSFIGPTGSERKGLFELTS
    St1  TTGKYEILGLKYADLQFEKGTGTYKISQEKYNDIKKKEGVDSDSEFKFTLYKNDLLLVKDTETKEQQLERFLSRTMPKQKHYVELKP....YDKQKF
    Cj   MDENYEFCFSLYKDS........LILIQTKDMQEPEFVYYNAFTSTVSLIVSKHDNKFETLSKNQKILFKN...............
    Mm   EKETDEIIFSQSNFLKIDQRQNFSFHNTLYWVQIWVYKNQKDQYCFISIDARNSKFEKDEIKINYEKLKTQKEKLQTINEEPILKIN.......KGDLFE

β24  β25   η11 β26     β27 η12
         1320      1330      1340      1350      1360
    Sp   LGAPAAFKYFDTTTDRKR.YTSTKEVLDATLIHQSITGLYETRIDLSQLGGD........
    Sm   IGAPATFKFFDKNIDRKR.YTSTTEILNATLIHQSITGLYETRIDLNKLGGD........
    St3  RGSAADFEFLGVKIFPRYRDYYPSSLLKDATLIHQSVTGLYETRIDLAKLGEG........
    St1  EGGEALIKVLGNVANSGQ..CKKGLGKSNISIYKVRTDVLGNQHIIKNEGDKPKLDF...
    Cj   ...ANEKEVIAKSIGIQN..LKVFEKYIVSALGEVTKAEFRQREFEFKK...........
    Mm   NEEKELFYIVGRDEKPQKLEIKYILGKKIKDQKQIQKPVKKYFPNWKKVNLTYMGEIFKK
```

FIG. 40B

FIG. 64A
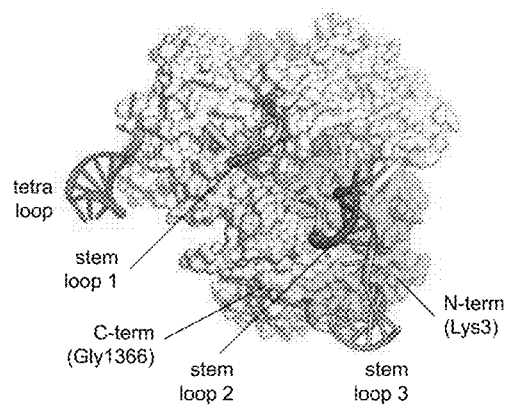
FIG. 64B
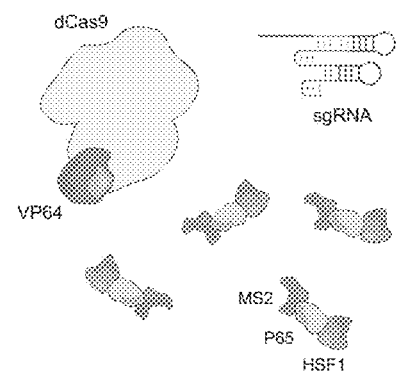
FIG. 64C
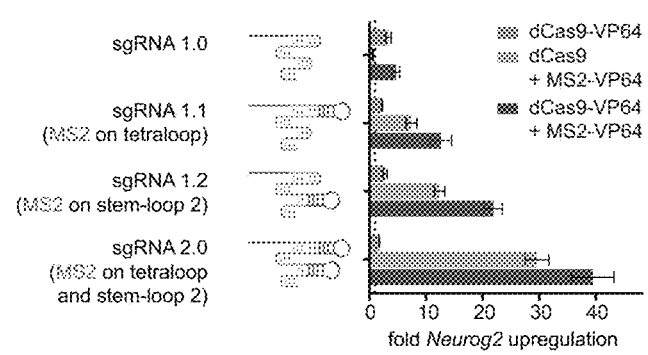
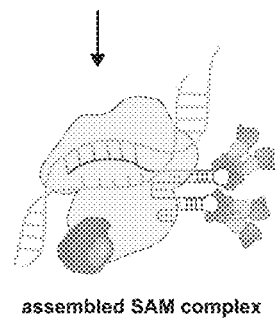
FIG. 64D
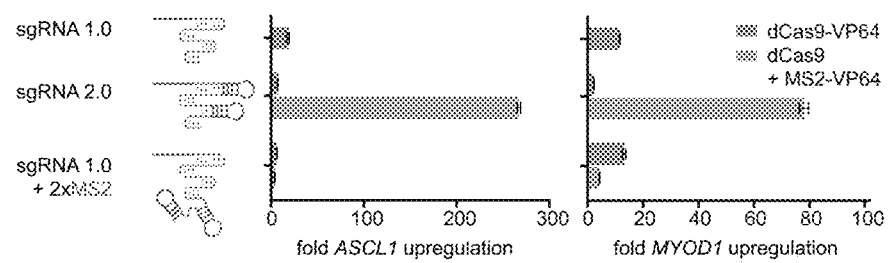
FIG. 64E
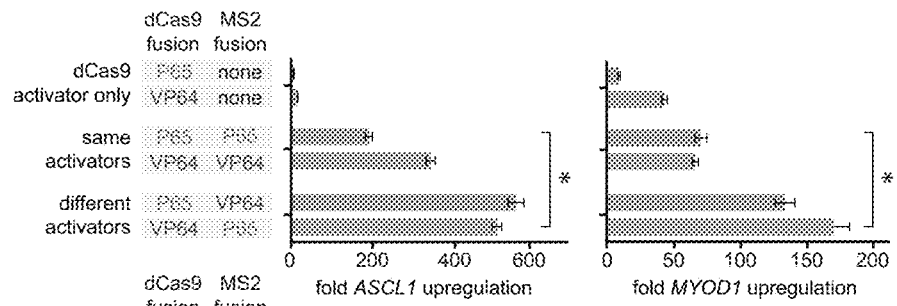
FIG. 64F
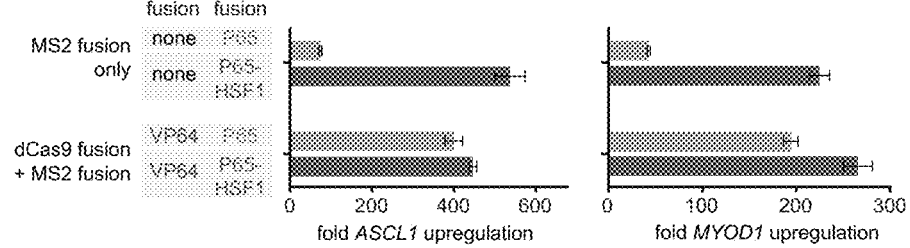

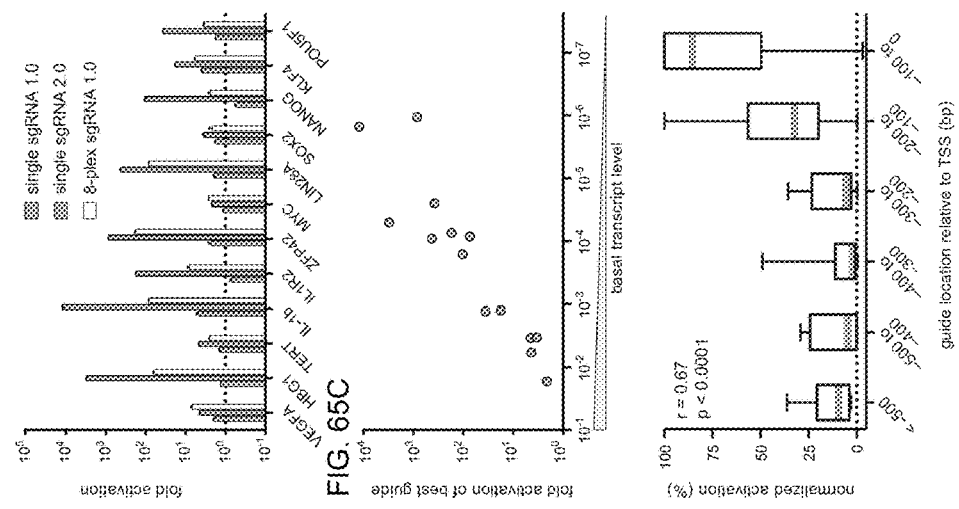
FIG. 65B
FIG. 65C
FIG. 65D
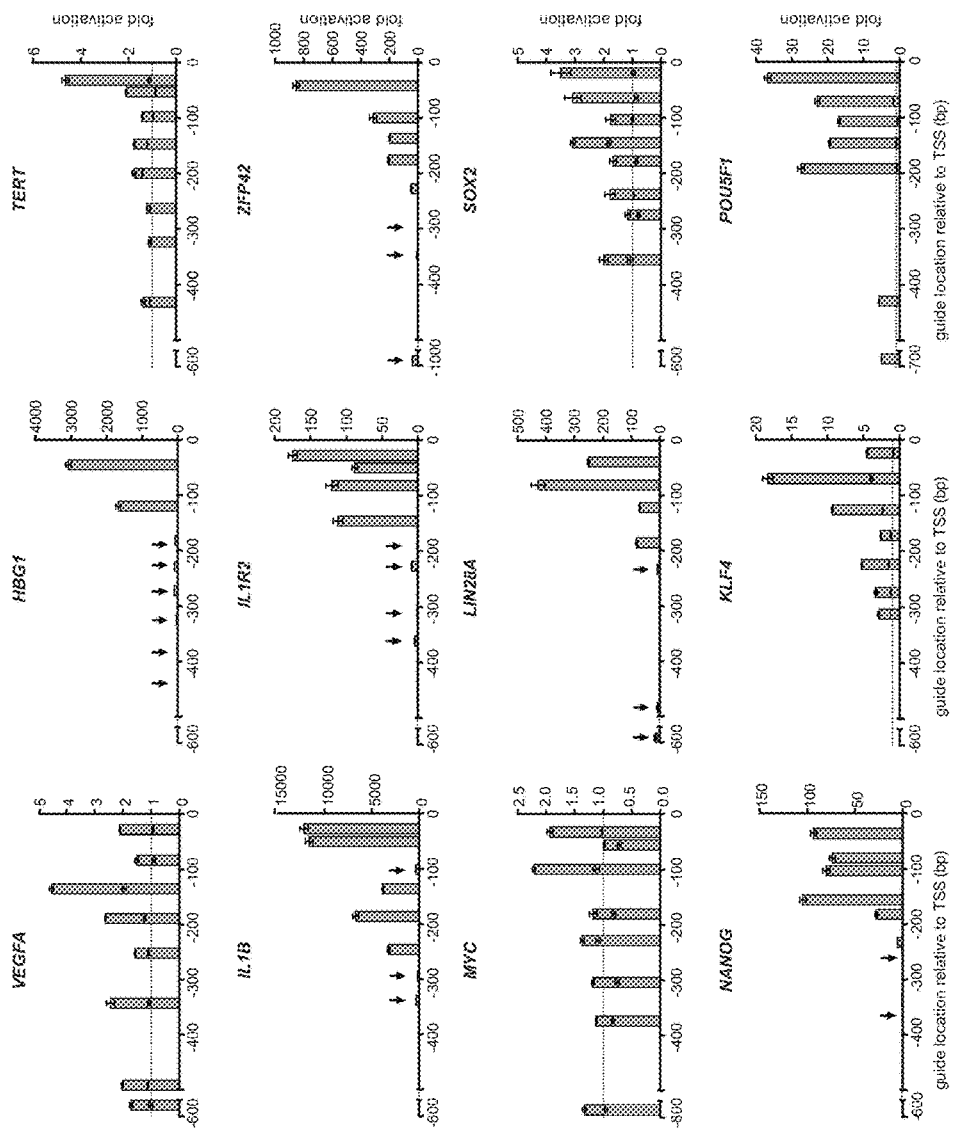
FIG. 65A

FIG. 67A
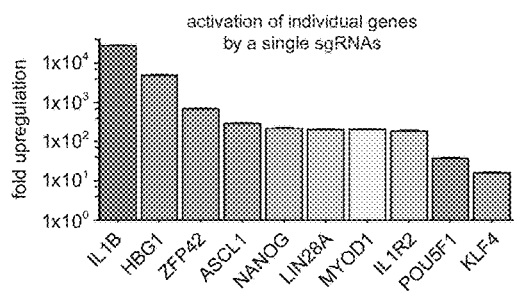
FIG. 67B
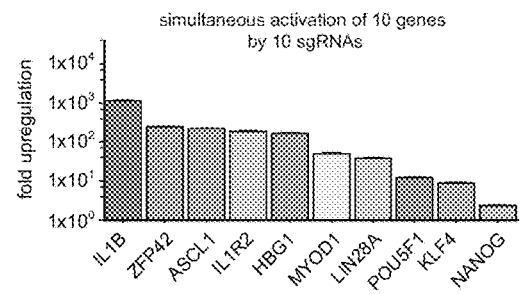
FIG. 67C
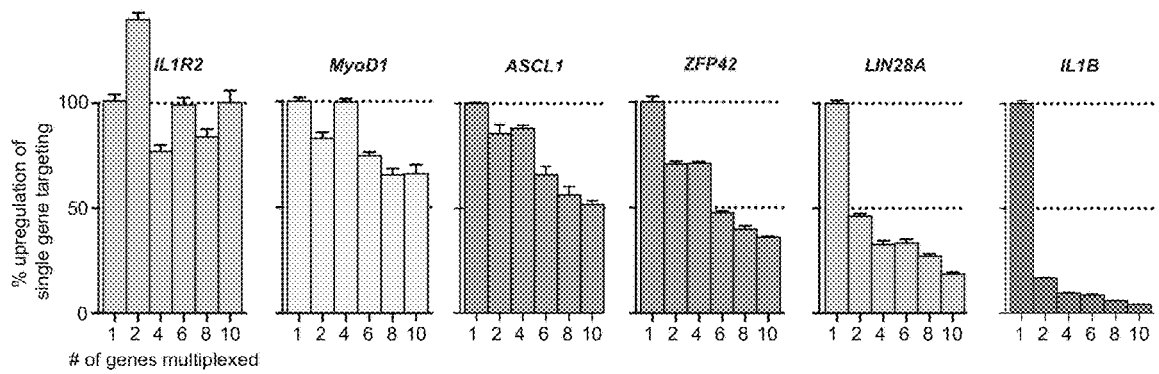
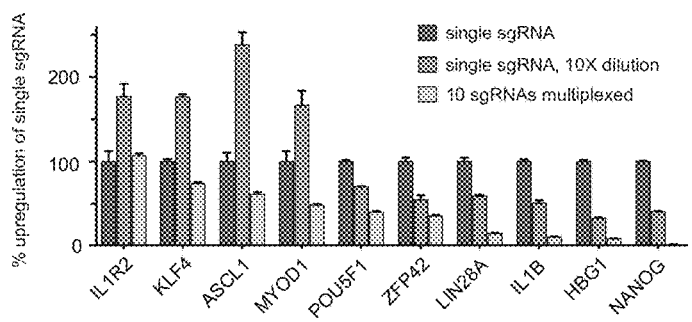
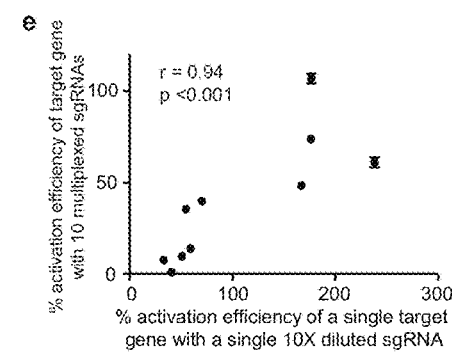
FIG. 67D
FIG. 67E FIG. 68A
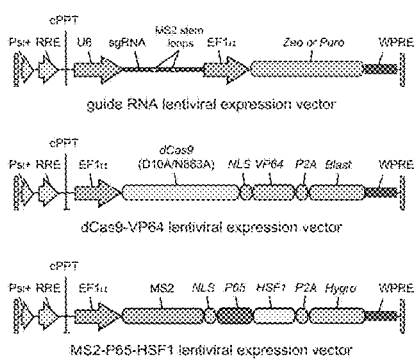
FIG. 68B
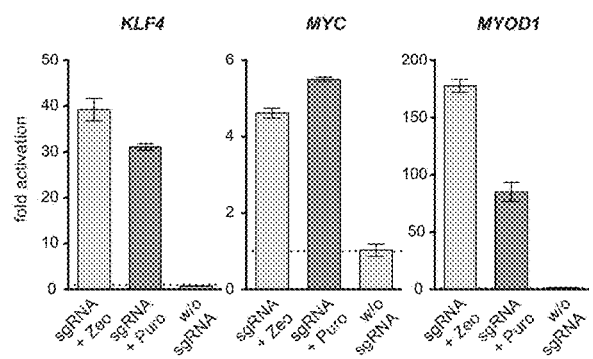
FIG. 68C
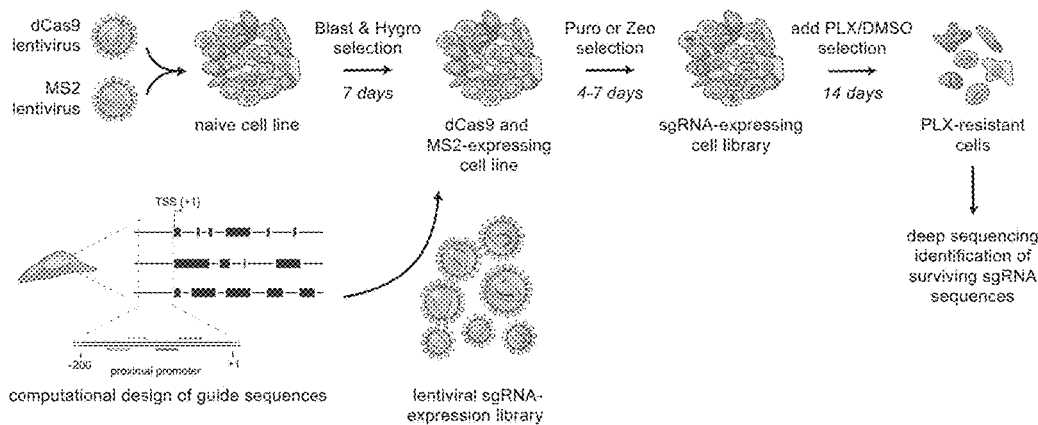
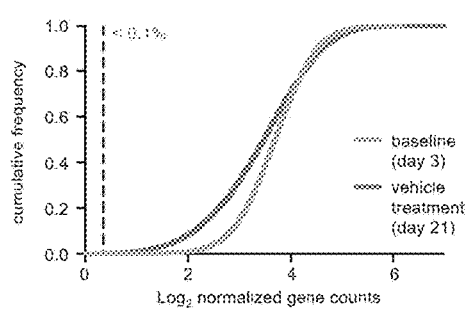
FIG. 68D
FIG. 68E tetraloop    stem-loop 1    stem-loop 2    stem-loop 3

FIG. 76A
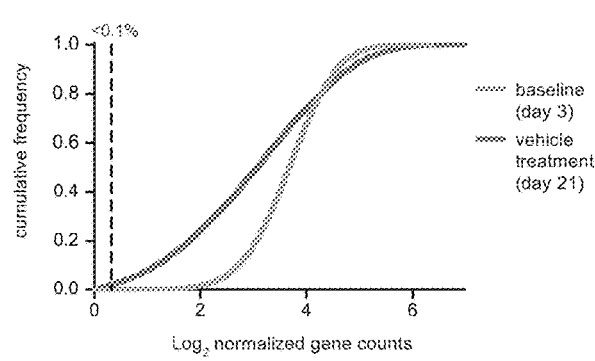
FIG. 76B
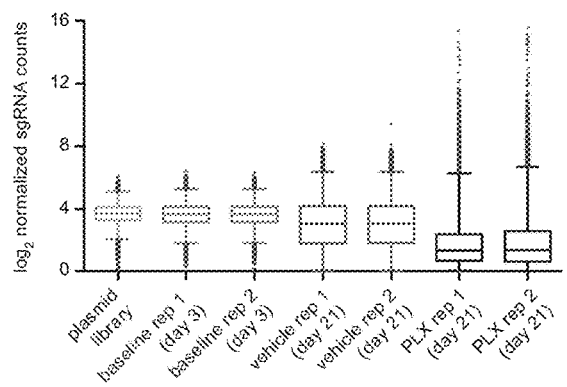
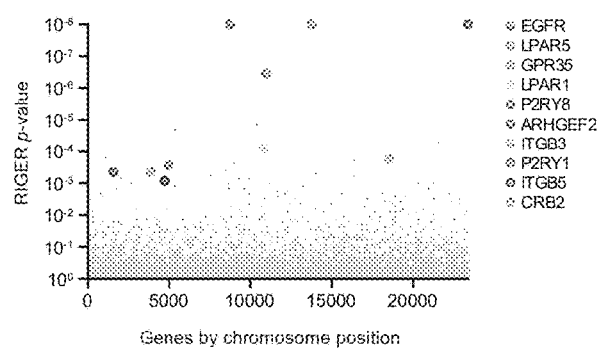
FIG. 76C
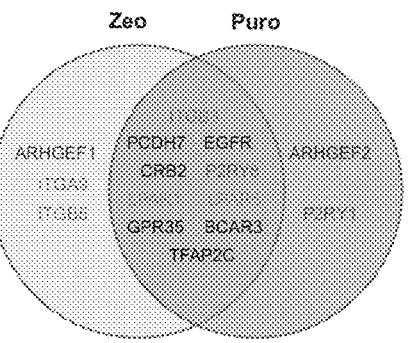
FIG. 76D FIG. 79A
FIG. 79B
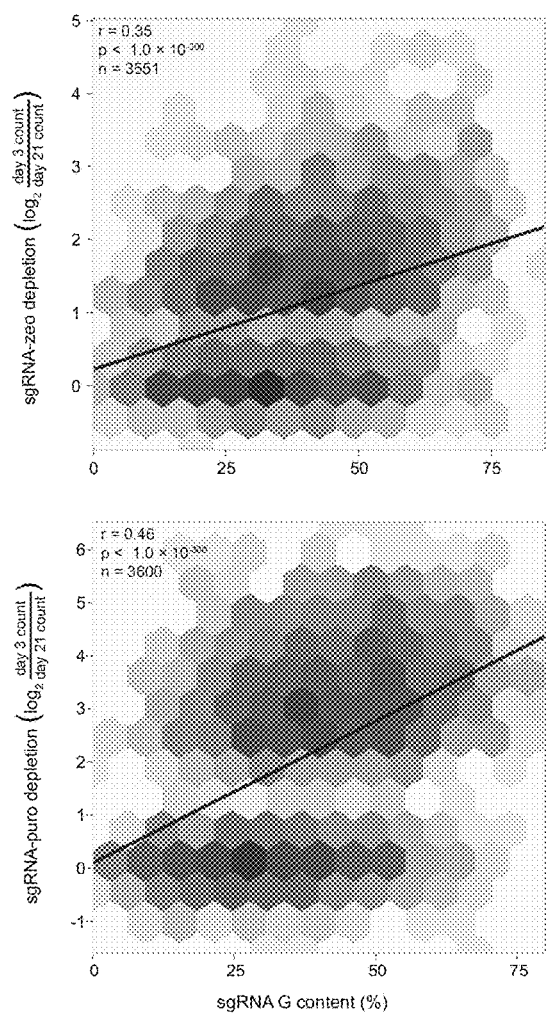
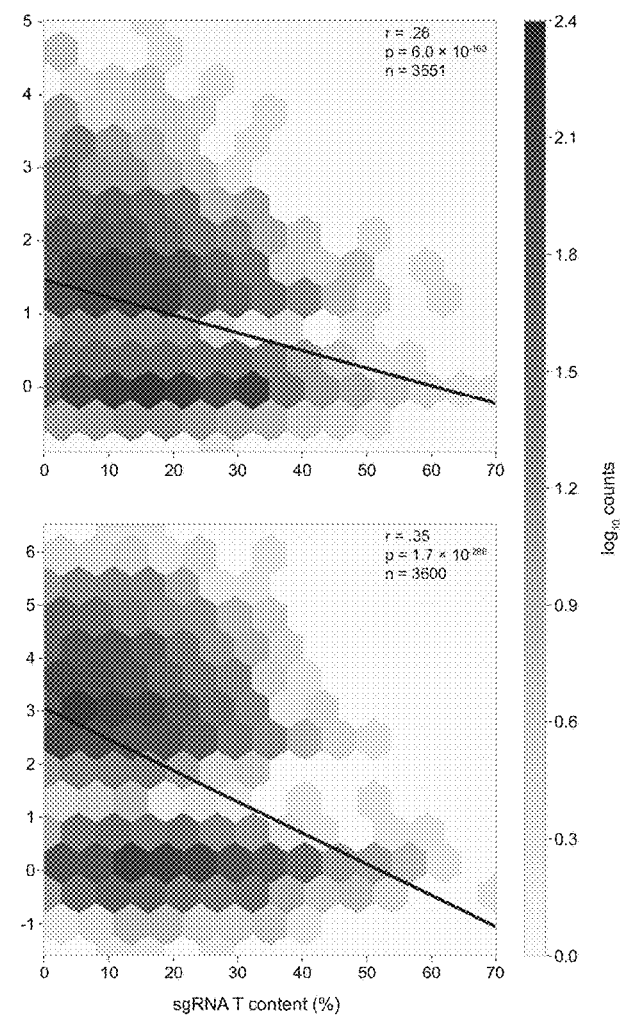
FIG. 79C
FIG. 79D 1    SgRNA Scaffolds 1.1  Standard guide scaffold (sgRNA 1.0)

NNNNNNNNNNNNNNNNNNNNGTTTTAGAGCTAGAAATAGCAAGTTAAAATAAGGCTAGTCCGTT
ATCAACTTGAAAAAGTGGCACCGAGTCGGTGCTTTTT 1.2  Tetraloop MS2 stem loop insertion sgRNA scaffold (sgRNA 1.1)

NNNNNNNNNNNNNNNNNNNNGTTTTAGAGCTAGGCCAACATGAGGATCACCCATGTCTGCAGGG
CCTAGCAAGTTAAAATAAGGCTAGTCCGTTATCACGCCGAAAGGCGGGCACCGAGTCGGTGCTT
TTT 1.3  Loop 2 MS2 stem loop insertion sgRNA scaffold (sgRNA 1.2)

NNNNNNNNNNNNNNNNNNNNGTTTTAGAGCTAGAAATAGCAAGTTAAAATAAGGCTAGTCCGTT
ATCAACTTGGCCAACATGAGGATCACCCATGTCTGCAGGGCCAAGTGGCACCGAGTCGGTGCTT
TTT 1.4  Tetraloop and Loop 2 MS2 stem loop insertion sgRNA scaffold (sgRNA 2.0)

NNNNNNNNNNNNNNNNNNNNGTTTTAGAGCTAGGCCAACATGAGGATCACCCATGTCTGCAGGG
CCTAGCAAGTTAAAATAAGGCTAGTCCGTTATCAACTTGGCCAACATGAGGATCACCCATGTCT
GCAGGGCCAAGTGGCACCGAGTCGGTGCTTTTT

2    MS2 Constructs

FIG. 80A

2.1 MS2-NLS-VP64

ATGGCTTCAAACTTTACTCAGTTCGTGCTCGTGGACAATGGTGGGACAGGGGATGTGACAGTGG
CTCCTTCTAATTTCGCTAATGGGGTGGCAGAGTGGATCAGCTCCAACTCACGGAGCCAGGCCTA
CAAGGTGACATGCAGCGTCAGGCAGTCTAGTGCCCAGAAGAGAAAGTATACCATCAAGGTGGAG
GTCCCCAAAGTGGCTACCCAGACAGTGGGCGGAGTCGAACTGCCTGTCGCCGCTTGGAGGTCCT
ACCTGAACATGGAGCTCACTATCCCAATTTTCGCTACCAATTCTGACTGTGAACTCATCGTGAA
GGCAATGCAGGGGCTCCTCAAAGACGGTAATCCTATCCCTTCCGCCATCGCCGCTAACTCAGGT
ATCTACAGCGCTGGAGGAGGTGGAAGCGGAGGAGGAGGAAGCGGAGGAGGAGGTAGCGGACCTA
AGAAAAAGAGGAAGGTGGCGGCCGCTGGATCCGGACGGGCTGACGCATTGGACGATTTTGATCT
GGATATGCTGGGAAGTGACGCCCTCGATGATTTTGACCTTGACATGCTTGGTTCGGATGCCCTT
GATGACTTTGACCTCGACATGCTCGGCAGTGACGCCCTTGATGATTTCGACCTGGACATGCTGA
TTAAC

2.1.1 MS2

ATGGCTTCAAACTTTACTCAGTTCGTGCTCGTGGACAATGGTGGGACAGGGGATGTGACAGTGG
CTCCTTCTAATTTCGCTAATGGGGTGGCAGAGTGGATCAGCTCCAACTCACGGAGCCAGGCCTA
CAAGGTGACATGCAGCGTCAGGCAGTCTAGTGCCCAGAAGAGAAAGTATACCATCAAGGTGGAG
GTCCCCAAAGTGGCTACCCAGACAGTGGGCGGAGTCGAACTGCCTGTCGCCGCTTGGAGGTCCT
ACCTGAACATGGAGCTCACTATCCCAATTTTCGCTACCAATTCTGACTGTGAACTCATCGTGAA
GGCAATGCAGGGGCTCCTCAAAGACGGTAATCCTATCCCTTCCGCCATCGCCGCTAACTCAGGT
ATCTAC

2.1.2 NLS

GGACCTAAGAAAAAGAGGAAGGTGGCGGCCGCT

2.1.3 VP64

GGACGGGCTGACGCATTGGACGATTTTGATCTGGATATGCTGGGAAGTGACGCCCTCGATGATT
TTGACCTTGACATGCTTGGTTCGGATGCCCTTGATGACTTTGACCTCGACATGCTCGGCAGTGA
CGCCCTTGATGATTTCGACCTGGACATGCTGATTAAC

FIG. 80B

2.2    MS2-NLS-P65

ATGGCTTCAAACTTTACTCAGTTCGTGCTCGTGGACAATGGTGGGACAGGGGATGTGACAGTGG
CTCCTTCTAATTTCGCTAATGGGGTGGCAGAGTGGATCAGCTCCAACTCACGGAGCCAGGCCTA
CAAGGTGACATGCAGCGTCAGGCAGTCTAGTGCCCAGAAGAGAAAGTATACCATCAAGGTGGAG
GTCCCCAAAGTGGCTACCCAGACAGTGGGCGGAGTCGAACTGCCTGTCGCCGCTTGGAGGTCCT
ACCTGAACATGGAGCTCACTATCCCAATTTTCGCTACCAATTCTGACTGTAACTCATCGTGAA
GGCAATGCAGGGGCTCCTCAAAGACGGTAATCCTATCCCTTCCGCCATCGCCGCTAACTCAGGT
ATCTACAGCGCTGGAGGAGGTGGAAGCGGAGGAGGAGGAAGCGGAGGAGGAGGTAGCGGACCTA
AGAAAAAGAGGAAGGTGGCGGCCGCTGGATCCCCTTCAGGGCAGATCAGCAACCAGGCCCTGGC
TCTGGCCCCTAGCTCCGCTCCAGTGCTGGCCCAGACTATGGTGCCCTCTAGTGCTATGGTGCCT
CTGGCCCAGCCACCTGCTCCAGCCCCTGTGCTGACCCCAGGACCACCCCAGTCACTGAGCGCTC
CAGTGCCCAAGTCTACACAGGCCGGCGAGGGGACTCTGAGTGAAGCTCTGCTGCACCTGCAGTT
CGACGCTGATGAGGACCTGGGAGCTCTGCTGGGGAACAGCACCGATCCCGGAGTGTTCACAGAT
CTGGCCTCCGTGGACAACTCTGAGTTTCAGCAGCTGCTGAATCAGGGCGTGTCCATGTCTCATA
GTACAGCCGAACCAATGCTGATGGAGTACCCCGAAGCCATTACCCGGCTGGTGACCGGCAGCCA
GCGGCCCCCCGACCCCGCTCCAACTCCCCTGGGAACCAGCGGCCTGCCTAATGGGCTGTCCGGA
GATGAAGACTTCTCAAGCATCGCTGATATGGACTTTAGTGCCCTGCTGTCACAGATTTCCTCTA
GTGGGCAG

2.2.1 MS2

ATGGCTTCAAACTTTACTCAGTTCGTGCTCGTGGACAATGGTGGGACAGGGGATGTGACAGTGG
CTCCTTCTAATTTCGCTAATGGGGTGGCAGAGTGGATCAGCTCCAACTCACGGAGCCAGGCCTA
CAAGGTGACATGCAGCGTCAGGCAGTCTAGTGCCCAGAAGAGAAAGTATACCATCAAGGTGGAG
GTCCCCAAAGTGGCTACCCAGACAGTGGGCGGAGTCGAACTGCCTGTCGCCGCTTGGAGGTCCT
ACCTGAACATGGAGCTCACTATCCCAATTTTCGCTACCAATTCTGACTGTGAACTCATCGTGAA
GGCAATGCAGGGGCTCCTCAAAGACGGTAATCCTATCCCTTCCGCCATCGCCGCTAACTCAGGT
ATCTAC

2.2.2 NLS

GGACCTAAGAAAAAGAGGAAGGTGGCGGCCGCT

CCTTCAGGGCAGATCAGCAACCAGGCCCTGGCTCTGGCCCCTAGCTCCGCTCCAGTGCTGGCCC
AGACTATGGTGCCCTCTAGTGCTATGGTGCCTCTGGCCCAGCCACCTGCTCCAGCCCCTGTGCT
GACCCCAGGACCACCCCAGTCACTGAGCGCTCCAGTGCCCAAGTCTACACAGGCCGGCGAGGGG
ACTCTGAGTGAAGCTCTGCTGCACCTGCAGTTCGACGCTGATGAGGACCTGGGAGCTCTGCTGG
GGAACAGCACCGATCCCGGAGTGTTCACAGATCTGGCCTCCGTGGACAACTCTGAGTTTCAGCA
GCTGCTGAATCAGGGCGTGTCCATGTCTCATAGTACAGCCGAACCAATGCTGATGGAGTACCCC
GAAGCCATTACCCGGCTGGTGACCGGCAGCCAGCGGCCCCCCGACCCCGCTCCAACTCCCCTGG
GAACCAGCGGCCTGCCTAATGGGCTGTCCGGAGATGAAGACTTCTCAAGCATCGCTGATATGGA
CTTTAGTGCCCTGCTGTCACAGATTTCCTCTAGTGGGCAG

2.3 MS2-NLS-P65-HSF1

ATGGCTTCAAACTTTACTCAGTTCGTGCTCGTGGACAATGGTGGGACAGGGGATGTGACAGTGG
CTCCTTCTAATTTCGCTAATGGGGTGGCAGAGTGGATCAGCTCCAACTCACGGAGCCAGGCCTA
CAAGGTGACATGCAGCGTCAGGCAGTCTAGTGCCCAGAAGAGAAAGTATACCATCAAGGTGGAG
GTCCCCAAAGTGGCTACCCAGACAGTGGGCGGAGTCGAACTGCCTGTCGCCGCTTGGAGGTCCT
ACCTGAACATGGAGCTCACTATCCCAATTTTCGCTACCAATTCTGACTGTGAACTCATCGTGAA
GGCAATGCAGGGGCTCCTCAAAGACGGTAATCCTATCCCTTCCGCCATCGCCGCTAACTCAGGT
ATCTACAGCGCTGGAGGAGGTGGAAGCGGAGGAGGAGGAAGCGGAGGAGGAGGTAGCGGACCTA
AGAAAAAGAGGAAGGTGGCGGCCGCTGGATCCCCTTCAGGGCAGATCAGCAACCAGGCCCTGGC
TCTGGCCCCTAGCTCCGCTCCAGTGCTGGCCCAGACTATGGTGCCCTCTAGTGCTATGGTGCCT
CTGGCCCAGCCACCTGCTCCAGCCCCTGTGCTGACCCCAGGACCACCCCAGTCACTGAGCGCTC
CAGTGCCCAAGTCTACACAGGCCGGCGAGGGGACTCTGAGTGAAGCTCTGCTGCACCTGCAGTT
CGACGCTGATGAGGACCTGGGAGCTCTGCTGGGGAACAGCACCGATCCCGGAGTGTTCACAGAT
CTGGCCTCCGTGGACAACTCTGAGTTTCAGCAGCTGCTGAATCAGGGCGTGTCCATGTCTCATA
GTACAGCCGAACCAATGCTGATGGAGTACCCCGAAGCCATTACCCGGCTGGTGACCGGCAGCCA
GCGGCCCCCCGACCCCGCTCCAACTCCCCTGGGAACCAGCGGCCTGCCTAATGGGCTGTCCGGA
GATGAAGACTTCTCAAGCATCGCTGATATGGACTTTAGTGCCCTGCTGTCACAGATTTCCTCTA
GTGGGCAGGGAGGAGGTGGAAGCGGCTTCAGCGTGGACACCAGTGCCCTGCTGGACCTGTTCAG
CCCCTCGGTGACCGTGCCCGACATGAGCCTGCCTGACCTTGACAGCAGCCTGGCCAGTATCCAA
GAGCTCCTGTCTCCCCAGGAGCCCCCAGGCCTCCGAGGCAGAGAACAGCAGCCCGGATTCAG
GGAAGCAGCTGGTGCACTACACAGCGCAGCCGCTGTTCCTGCTGGACCCCGGCTCCGTGGACAC
CGGGAGCAACGACCTGCCGGTGCTGTTTGAGCTGGGAGAGGGCTCCTACTTCTCCGAAGGGGAC
GGCTTCGCCGAGGACCCCACCATCTCCCTGCTGACAGGCTCGGAGCCTCCCAAAGCCAAGGACC
CCACTGTCTCC

ATGGCTTCAAACTTTACTCAGTTCGTGCTCGTGGACAATGGTGGGACAGGGGATGTGACAGTGG
CTCCTTCTAATTTCGCTAATGGGGTGGCAGAGTGGATCAGCTCCAACTCACGGAGCCAGGCCTA
CAAGGTGACATGCAGCGTCAGGCAGTCTAGTGCCCAGAAGAGAAAGTATACCATCAAGGTGGAG
GTCCCCAAAGTGGCTACCCAGACAGTGGGCGGAGTCGAACTGCCTGTCGCCGCTTGGAGGTCCT
ACCTGAACATGGAGCTCACTATCCCAATTTTCGCTACCAATTCTGACTGTGAACTCATCGTGAA
GGCAATGCAGGGGCTCCTCAAAGACGGTAATCCTATCCCTTCCGCCATCGCCGCTAACTCAGGT
ATCTAC

2.3.2 NLS

GGACCTAAGAAAAAGAGGAAGGTGGCGGCCGCT

2.3.3 P65

CCTTCAGGGCAGATCAGCAACCAGGCCCTGGCTCTGGCCCCTAGCTCCGCTCCAGTGCTGGCCC
AGACTATGGTGCCCTCTAGTGCTATGGTGCCTCTGGCCCAGCCACCTGCTCCAGCCCCTGTGCT
GACCCCAGGACCACCCCAGTCACTGAGCGCTCCAGTGCCCAAGTCTACACAGGCCGGCGAGGGG
ACTCTGAGTGAAGCTCTGCTGCACCTGCAGTTCGACGCTGATGAGGACCTGGGAGCTCTGCTGG
GGAACAGCACCGATCCCGGAGTGTTCACAGATCTGGCCTCCGTGGACAACTCTGAGTTTCAGCA
GCTGCTGAATCAGGGCGTGTCCATGTCTCATAGTACAGCCGAACCAATGCTGATGGAGTACCCC
GAAGCCATTACCCGGCTGGTGACCGGCAGCCAGCGGCCCCCCGACCCCGCTCCAACTCCCCTGG
GAACCAGCGGCCTGCCTAATGGGCTGTCCGGAGATGAAGACTTCTCAAGCATCGCTGATATGGA
CTTTAGTGCCCTGCTGTCACAGATTTCCTCTAGTGGGCAG

2.3.4 HSF1

GGCTTCAGCGTGGACACCAGTGCCCTGCTGGACCTGTTCAGCCCCTCGGTGACCGTGCCCGACA
TGAGCCTGCCTGACCTTGACAGCAGCCTGGCCAGTATCCAAGAGCTCCTGTCTCCCCAGGAGCC
CCCCAGGCCTCCCGAGGCAGAGAACAGCAGCCCGGATTCAGGGAAGCAGCTGGTGCACTACACA
GCGCAGCCGCTGTTCCTGCTGGACCCCGGCTCCGTGGACACCGGGAGCAACGACCTGCCGGTGC
TGTTTGAGCTGGGAGAGGGCTCCTACTTCTCCGAAGGGGACGGCTTCGCCGAGGACCCCACCAT
CTCCCTGCTGACAGGCTCGGAGCCTCCCAAAGCCAAGGACCCCACTGTCTCC

FIG. 80E

2.4 MS2-NLS-P65-Myod1

ATGGCTTCAAACTTTACTCAGTTCGTGCTCGTGGACAATGGTGGGACAGGGGATGTGACAGTGG
CTCCTTCTAATTTCGCTAATGGGGTGGCAGAGTGGATCAGCTCCAACTCACGGAGCCAGGCCTA
CAAGGTGACATGCAGCGTCAGGCAGTCTAGTGCCCAGAAGAGAAAGTATACCATCAAGGTGGAG
GTCCCCAAAGTGGCTACCCAGACAGTGGGCGGAGTCGAACTGCCTGTCGCCGCTTGGAGGTCCT
ACCTGAACATGGAGCTCACTATCCCAATTTTCGCTACCAATTCTGACTGTGAACTCATCGTGAA
GGCAATGCAGGGGCTCCTCAAAGACGGTAATCCTATCCCTTCCGCCATCGCCGCTAACTCAGGT
ATCTACAGCGCTGGAGGAGGTGGAAGCGGAGGAGGAGGAAGCGGAGGAGGAGGTAGCGGACCTA
AGAAAAAGAGGAAGGTGGCGGCCGCTGGATCCCCTTCAGGGCAGATCAGCAACCAGGCCCTGGC
TCTGGCCCCTAGCTCCGCTCCAGTGCTGGCCCAGACTATGGTGCCCTCTAGTGCTATGGTGCCT
CTGGCCCAGCCACCTGCTCCAGCCCCTGTGCTGACCCCAGGACCACCCCAGTCACTGAGCGCTC
CAGTGCCCAAGTCTACACAGGCCGGCGAGGGGACTCTGAGTGAAGCTCTGCTGCACCTGCAGTT
CGACGCTGATGAGGACCTGGGAGCTCTGCTGGGGAACAGCACCGATCCCGGAGTGTTCACAGAT
CTGGCCTCCGTGGACAACTCTGAGTTTCAGCAGCTGCTGAATCAGGGCGTGTCCATGTCTCATA
GTACAGCCGAACCAATGCTGATGGAGTACCCCGAAGCCATTACCCGGCTGGTGACCGGCAGCCA
GCGGCCCCCGACCCCGCTCCAACTCCCCTGGGAACCAGCGGCCTGCCTAATGGGCTGTCCGGA
GATGAAGACTTCTCAAGCATCGCTGATATGGACTTTAGTGCCCTGCTGTCACAGATTTCCTCTA
GTGGGCAGGGAGGAGGTGGAAGCATGGAGCTTCTTTCTCCTCCTCTGCGGGATGTTGACCTGAC
TGCGCCCGACGGCTCTCTTTGCTCCTTCGCCACAACCGACGACTTCTACGATGATCCATGTTTT
GACAGCCCCGATCTCAGGTTCTTTGAGGATCTCGATCCTAGACTGATGCACGTGGGCGCACTGC
TCAAACCTGAGGAACATAGC

2.4.1 MS2

ATGGCTTCAAACTTTACTCAGTTCGTGCTCGTGGACAATGGTGGGACAGGGGATGTGACAGTGG
CTCCTTCTAATTTCGCTAATGGGGTGGCAGAGTGGATCAGCTCCAACTCACGGAGCCAGGCCTA
CAAGGTGACATGCAGCGTCAGGCAGTCTAGTGCCCAGAAGAGAAAGTATACCATCAAGGTGGAG
GTCCCCAAAGTGGCTACCCAGACAGTGGGCGGAGTCGAACTGCCTGTCGCCGCTTGGAGGTCCT
ACCTGAACATGGAGCTCACTATCCCAATTTTCGCTACCAATTCTGACTGTGAACTCATCGTGAA
GGCAATGCAGGGGCTCCTCAAAGACGGTAATCCTATCCCTTCCGCCATCGCCGCTAACTCAGGT
ATCTAC

2.4.2 NLS

GGACCTAAGAAAAAGAGGAAGGTGGCGGCCGCT

CCTTCAGGGCAGATCAGCAACCAGGCCCTGGCTCTGGCCCCTAGCTCCGCTCCAGTGCTGGCCC
AGACTATGGTGCCCTCTAGTGCTATGGTGCCTCTGGCCCAGCCACCTGCTCCAGCCCCTGTGCT
GACCCCAGGACCACCCCAGTCACTGAGCGCTCCAGTGCCCAAGTCTACACAGGCCGGCGAGGGG
ACTCTGAGTGAAGCTCTGCTGCACCTGCAGTTCGACGCTGATGAGGACCTGGGAGCTCTGCTGG
GGAACAGCACCGATCCCGGAGTGTTCACAGATCTGGCCTCCGTGGACAACTCTGAGTTTCAGCA
GCTGCTGAATCAGGGCGTGTCCATGTCTCATAGTACAGCCGAACCAATGCTGATGGAGTACCCC
GAAGCCATTACCCGGCTGGTGACCGGCAGCCAGCGGCCCCCCGACCCGCTCCAACTCCCCTGG
GAACCAGCGGCCTGCCTAATGGGCTGTCCGGAGATGAAGACTTCTCAAGCATCGCTGATATGGA
CTTTAGTGCCCTGCTGTCACAGATTTCCTCTAGTGGGCAG

2.4.4 Myod1

ATGGAGCTTCTTTCTCCTCCTCTGCGGGATGTTGACCTGACTGCGCCCGACGGCTCTCTTTGCT
CCTTCGCCACAACCGACGACTTCTACGATGATCCATGTTTTGACAGCCCCGATCTCAGGTTCTT
TGAGGATCTCGATCCTAGACTGATGCACGTGGGCGCACTGCTCAAACCTGAGGAACATAGC

3    dCas9 Constructs

3.1    dCas9(D10A, H840A)-NLS-VP64

GACAAGAAGTACAGCATCGGCCTGGCCATCGGCACCAACTCTGTGGGCTGGGCCGTGATCACCG
ACGAGTACAAGGTGCCCAGCAAGAAATTCAAGGTGCTGGGCAACACCGACCGGCACAGCATCAA
GAAGAACCTGATCGGAGCCCTGCTGTTCGACAGCGGCGAAACAGCCGAGGCCACCCGGCTGAAG
AGAACCGCCAGAAGAAGATACACCAGACGGAAGAACCGGATCTGCTATCTGCAAGAGATCTTCA
GCAACGAGATGGCCAAGGTGGACGACAGCTTCTTCCACAGACTGGAAGAGTCCTTCCTGGTGGA
AGAGGATAAGAAGCACGAGCGGCACCCCATCTTCGGCAACATCGTGGACGAGGTGGCCTACCAC
GAGAAGTACCCCACCATCTACCACCTGAGAAAGAAACTGGTGGACAGCACCGACAAGGCCGACC
TGCGGCTGATCTATCTGGCCCTGGCCCACATGATCAAGTTCCGGGGCCACTTCCTGATCGAGGG
CGACCTGAACCCCGACAACAGCGACGTGGACAAGCTGTTCATCCAGCTGGTGCAGACCTACAAC
CAGCTGTTCGAGGAAAACCCCATCAACGCCAGCGGCGTGGACGCCAAGGCCATCCTGTCTGCCA
GACTGAGCAAGAGCAGACGGCTGGAAAATCTGATCGCCCAGCTGCCCGGCGAGAAGAAGAATGG
CCTGTTCGGCAACCTGATTGCCCTGAGCCTGGGCCTGACCCCCAACTTCAAGAGCAACTTCGAC
CTGGCCGAGGATGCCAAACTGCAGCTGAGCAAGGACACCTACGACGACGACCTGGACAACCTGC

FIG. 80G

```
TGGCCCAGATCGGCGACCAGTACGCCGACCTGTTTCTGGCCGCCAAGAACCTGTCCGACGCCAT
CCTGCTGAGCGACATCCTGAGAGTGAACACCGAGATCACCAAGGCCCCCCTGAGCGCCTCTATG
ATCAAGAGATACGACGAGCACCACCAGGACCTGACCCTGCTGAAAGCTCTCGTGCGGCAGCAGC
TGCCTGAGAAGTACAAAGAGATTTTCTTCGACCAGAGCAAGAACGGCTACGCCGGCTACATTGA
CGGCGGAGCCAGCCAGGAAGAGTTCTACAAGTTCATCAAGCCCATCCTGGAAAAGATGGACGGC
ACCGAGGAACTGCTCGTGAAGCTGAACAGAGAGGACCTGCTGCGGAAGCAGCGGACCTTCGACA
ACGGCAGCATCCCCACCAGATCCACCTGGGAGAGCTGCACGCCATTCTGCGGCGGCAGGAAGA
TTTTTACCCATTCCTGAAGGACAACCGGGAAAAGATCGAGAAGATCCTGACCTTCCGCATCCCC
TACTACGTGGGCCCTCTGGCCAGGGGAAACAGCAGATTCGCCTGGATGACCAGAAAGAGCGAGG
AAACCATCACCCCTGGAACTTCGAGGAAGTGGTGGACAAGGGCGCTTCCGCCCAGAGCTTCAT
CGAGCGGATGACCAACTTCGATAAGAACCTGCCCAACGAGAAGGTGCTGCCCAAGCACAGCCTG
CTGTACGAGTACTTCACCGTGTATAACGAGCTGACCAAAGTGAAATACGTGACCGAGGGAATGA
GAAAGCCCGCCTTCCTGAGCGGCGAGCAGAAAAAGGCCATCGTGGACCTGCTGTTCAAGACCAA
CCGGAAAGTGACCGTGAAGCAGCTGAAAGAGGACTACTTCAAGAAAATCGAGTGCTTCGACTCC
GTGGAAATCTCCGGCGTGGAAGATCGGTTCAACGCCTCCCTGGGCACATACCACGATCTGCTGA
AAATTATCAAGGACAAGGACTTCCTGGACAATGAGGAAAACGAGGACATTCTGGAAGATATCGT
GCTGACCCTGACACTGTTTGAGGACAGAGAGATGATCGAGGAACGGCTGAAAACCTATGCCCAC
CTGTTCGACGACAAAGTGATGAAGCAGCTGAAGCGGCGGAGATACACCGGCTGGGGCAGGCTGA
GCCGGAAGCTGATCAACGGCATCCGGGACAAGCAGTCCGGCAAGACAATCCTGGATTTCCTGAA
GTCCGACGGCTTCGCCAACAGAAACTTCATGCAGCTGATCCACGACGACAGCCTGACCTTTAAA
GAGGACATCCAGAAAGCCCAGGTGTCCGGCCAGGGCGATAGCCTGCACGAGCACATTGCCAATC
TGGCCGGCAGCCCCGCCATTAAGAAGGGCATCCTGCAGACAGTGAAGGTGGTGGACGAGCTCGT
GAAAGTGATGGGCCGGCACAAGCCCGAGAACATCGTGATCGAAATGGCCAGAGAGAACCAGACC
ACCCAGAAGGGACAGAAGAACAGCCGCGAGAGAATGAAGCGGATCGAAGAGGGCATCAAAGAGC
TGGGCAGCCAGATCCTGAAAGAACACCCCGTGGAAAACACCCAGCTGCAGAACGAGAAGCTGTA
CCTGTACTACCTGCAGAATGGGCGGGATATGTACGTGGACCAGGAACTGGACATCAACCGGCTG
TCCGACTACGATGTGGACGCTATCGTGCCTCAGAGCTTTCTGAAGGACGACTCCATCGACAACA
AGGTGCTGACCAGAAGCGACAAGAACCGGGGCAAGAGCGACAACGTGCCCTCCGAAGAGGTCGT
GAAGAAGATGAAGAACTACTGGCGGCAGCTGCTGAACGCCAAGCTGATTACCCAGAGAAAGTTC
GACAATCTGACCAAGGCCGAGAGAGGCGGCCTGAGCGAACTGGATAAGGCCGGCTTCATCAAGA
GACAGCTGGTGGAAACCCGGCAGATCACAAAGCACGTGGCACAGATCCTGGACTCCCGGATGAA
CACTAAGTACGACGAGAATGACAAGCTGATCCGGGAAGTGAAAGTGATCACCCTGAAGTCCAAG
CTGGTGTCCGATTTCCGGAAGGATTTCCAGTTTTACAAAGTGCGCGAGATCAACAACTACCACC
ACGCCCACGACGCCTACCTGAACGCCGTCGTGGGAACCGCCCTGATCAAAAAGTACCCTAAGCT
GGAAAGCGAGTTCGTGTACGGCGACTACAAGGTGTACGACGTGCGGAAGATGATCGCCAAGAGC
GAGCAGGAAATCGGCAAGGCTACCGCCAAGTACTTCTTCTACAGCAACATCATGAACTTTTTCA
```

FIG. 80H

AGACCGAGATTACCCTGGCCAACGGCGAGATCCGGAAGCGGCCTCTGATCGAGACAAACGGCGA
AACCGGGGAGATCGTGTGGGATAAGGGCCGGGATTTTGCCACCGTGCGGAAAGTGCTGAGCATG
CCCCAAGTGAATATCGTGAAAAGACCGAGGTGCAGACAGGCGGCTTCAGCAAAGAGTCTATCC
TGCCCAAGAGGAACAGCGATAAGCTGATCGCCAGAAAGAAGGACTGGGACCCTAAGAAGTACGG
CGGCTTCGACAGCCCCACCGTGGCCTATTCTGTGCTGGTGGTGGCCAAAGTGGAAAAGGGCAAG
TCCAAGAAACTGAAGAGTGTGAAAGAGCTGCTGGGGATCACCATCATGGAAAGAAGCAGCTTCG
AGAAGAATCCCATCGACTTTCTGGAAGCCAAGGGCTACAAAGAAGTGAAAAAGGACCTGATCAT
CAAGCTGCCTAAGTACTCCCTGTTCGAGCTGGAAAACGGCCGGAAGAGAATGCTGGCCTCTGCC
GGCGAACTGCAGAAGGGAAACGAACTGGCCCTGCCCTCCAAATATGTGAACTTCCTGTACCTGG
CCAGCCACTATGAGAAGCTGAAGGGCTCCCCCGAGGATAATGAGCAGAAACAGCTGTTTGTGGA
ACAGCACAAGCACTACCTGGACGAGATCATCGAGCAGATCAGCGAGTTCTCCAAGAGAGTGATC
CTGGCCGACGCTAATCTGGACAAAGTGCTGTCCGCCTACAACAAGCACGGGATAAGCCCATCA
GAGAGCAGGCCGAGAATATCATCCACCTGTTTACCCTGACCAATCTGGGAGCCCCTGCCGCCTT
CAAGTACTTTGACACCACCATCGACCGGAAGAGGTACACCAGCACCAAAGAGGTGCTGGACGCC
ACCCTGATCCACCAGAGCATCACCGGCCTGTACGAGACACGGATCGACCTGTCTCAGCTGGGAG
GCGACAGCGCTGGAGGAGGTGGAAGCGGAGGAGGAGGAAGCGGAGGAGGAGGTAGCGGACCTAA
GAAAAAGAGGAAGGTGGCGGCCGCTGGATCCGGACGGGCTGACGCATTGGACGATTTTGATCTG
GATATGCTGGGAAGTGACGCCCTCGATGATTTTGACCTTGACATGCTTGGTTCGGATGCCCTTG
ATGACTTTGACCTCGACATGCTCGGCAGTGACGCCCTTGATGATTTCGACCTGGACATGCTGAT
TAAC

3.1.1 dCas9(D10A, H840A)

GACAAGAAGTACAGCATCGGCCTGGCCATCGGCACCAACTCTGTGGGCTGGGCCGTGATCACCG
ACGAGTACAAGGTGCCCAGCAAGAAATTCAAGGTGCTGGGCAACACCGACCGGCACAGCATCAA
GAAGAACCTGATCGGAGCCCTGCTGTTCGACAGCGGCGAAACAGCCGAGGCCACCCGGCTGAAG
AGAACCGCCAGAAGAAGATACACCAGACGGAAGAACCGGATCTGCTATCTGCAAGAGATCTTCA
GCAACGAGATGGCCAAGGTGGACGACAGCTTCTTCCACAGACTGGAAGAGTCCTTCCTGGTGGA
AGAGGATAAGAAGCACGAGCGGCACCCCATCTTCGGCAACATCGTGGACGAGGTGGCCTACCAC
GAGAAGTACCCCACCATCTACCACCTGAGAAAGAAACTGGTGGACAGCACCGACAAGGCCGACC
TGCGGCTGATCTATCTGGCCCTGGCCCACATGATCAAGTTCCGGGGCCACTTCCTGATCGAGGG
CGACCTGAACCCCGACAACAGCGACGTGGACAAGCTGTTCATCCAGCTGGTGCAGACCTACAAC
CAGCTGTTCGAGGAAAACCCCATCAACGCCAGCGGCGTGGACGCCAAGGCCATCCTGTCTGCCA
GACTGAGCAAGAGCAGACGGCTGGAAAATCTGATCGCCCAGCTGCCCGGCGAGAAGAAGAATGG
CCTGTTCGGCAACCTGATTGCCCTGAGCCTGGGCCTGACCCCCAACTTCAAGAGCAACTTCGAC
CTGGCCGAGGATGCCAAACTGCAGCTGAGCAAGGACACCTACGACGACGACCTGGACAACCTGC

FIG. 80I

```
TGGCCCAGATCGGCGACCAGTACGCCGACCTGTTTCTGGCCGCCAAGAACCTGTCCGACGCCAT
CCTGCTGAGCGACATCCTGAGAGTGAACACCGAGATCACCAAGGCCCCCCTGAGCGCCTCTATG
ATCAAGAGATACGACGAGCACCACCAGGACCTGACCCTGCTGAAAGCTCTCGTGCGGCAGCAGC
TGCCTGAGAAGTACAAAGAGATTTTCTTCGACCAGAGCAAGAACGGCTACGCCGGCTACATTGA
CGGCGGAGCCAGCCAGGAAGAGTTCTACAAGTTCATCAAGCCCATCCTGGAAAAGATGGACGGC
ACCGAGGAACTGCTCGTGAAGCTGAACAGAGAGGACCTGCTGCGGAAGCAGCGGACCTTCGACA
ACGGCAGCATCCCCCACCAGATCCACCTGGGAGAGCTGCACGCCATTCTGCGGCGGCAGGAAGA
TTTTTACCCATTCCTGAAGGACAACCGGGAAAAGATCGAGAAGATCCTGACCTTCCGCATCCCC
TACTACGTGGGCCCTCTGGCCAGGGGAAACAGCAGATTCGCCTGGATGACCAGAAAGAGCGAGG
AAACCATCACCCCCTGGAACTTCGAGGAAGTGGTGGACAAGGGCGCTTCCGCCCAGAGCTTCAT
CGAGCGGATGACCAACTTCGATAAGAACCTGCCCAACGAGAAGGTGCTGCCCAAGCACAGCCTG
CTGTACGAGTACTTCACCGTGTATAACGAGCTGACCAAAGTGAAATACGTGACCGAGGGAATGA
GAAAGCCCGCCTTCCTGAGCGGCGAGCAGAAAAAGGCCATCGTGGACCTGCTGTTCAAGACCAA
CCGGAAAGTGACCGTGAAGCAGCTGAAAGAGGACTACTTCAAGAAAATCGAGTGCTTCGACTCC
GTGGAAATCTCCGGCGTGGAAGATCGGTTCAACGCCTCCCTGGGCACATACCACGATCTGCTGA
AAATTATCAAGGACAAGGACTTCCTGGACAATGAGGAAAACGAGGACATTCTGGAAGATATCGT
GCTGACCCTGACACTGTTTGAGGACAGAGAGATGATCGAGGAACGGCTGAAAACCTATGCCCAC
CTGTTCGACGACAAAGTGATGAAGCAGCTGAAGCGGCGGAGATACACCGGCTGGGGCAGGCTGA
GCCGGAAGCTGATCAACGGCATCCGGGACAAGCAGTCCGGCAAGACAATCCTGGATTTCCTGAA
GTCCGACGGCTTCGCCAACAGAAACTTCATGCAGCTGATCCACGACGACAGCCTGACCTTTAAA
GAGGACATCCAGAAAGCCCAGGTGTCCGGCCAGGGCGATAGCCTGCACGAGCACATTGCCAATC
TGGCCGGCAGCCCCGCCATTAAGAAGGGCATCCTGCAGACAGTGAAGGTGGTGGACGAGCTCGT
GAAAGTGATGGGCCGGCACAAGCCCGAGAACATCGTGATCGAAATGGCCAGAGAGAACCAGACC
ACCCAGAAGGGACAGAAGAACAGCCGCGAGAGAATGAAGCGGATCGAAGAGGGCATCAAAGAGC
TGGGCAGCCAGATCCTGAAAGAACACCCCGTGGAAAACACCCAGCTGCAGAACGAGAAGCTGTA
CCTGTACTACCTGCAGAATGGGCGGGATATGTACGTGGACCAGGAACTGGACATCAACCGGCTG
TCCGACTACGATGTGGACGCTATCGTGCCTCAGAGCTTTCTGAAGGACGACTCCATCGACAACA
AGGTGCTGACCAGAAGCGACAAGAACCGGGGCAAGAGCGACAACGTGCCCTCCGAAGAGGTCGT
GAAGAAGATGAAGAACTACTGGCGGCAGCTGCTGAACGCCAAGCTGATTACCCAGAGAAAGTTC
GACAATCTGACCAAGGCCGAGAGAGGCGGCCTGAGCGAACTGGATAAGGCCGGCTTCATCAAGA
GACAGCTGGTGGAAACCCGGCAGATCACAAAGCACGTGGCACAGATCCTGGACTCCCGGATGAA
CACTAAGTACGACGAGAATGACAAGCTGATCCGGGAAGTGAAAGTGATCACCCTGAAGTCCAAG
CTGGTGTCCGATTTCCGGAAGGATTTCCAGTTTTACAAAGTGCGCGAGATCAACAACTACCACC
ACGCCCACGACGCCTACCTGAACGCCGTCGTGGGAACCGCCCTGATCAAAAAGTACCCTAAGCT
GGAAAGCGAGTTCGTGTACGGCGACTACAAGGTGTACGACGTGCGGAAGATGATCGCCAAGAGC
GAGCAGGAAATCGGCAAGGCTACCGCCAAGTACTTCTTCTACAGCAACATCATGAACTTTTTCA
```

FIG. 80J

AGACCGAGATTACCCTGGCCAACGGCGAGATCCGGAAGCGGCCTCTGATCGAGACAAACGGCGA
AACCGGGGAGATCGTGTGGGATAAGGGCCGGGATTTTGCCACCGTGCGGAAAGTGCTGAGCATG
CCCCAAGTGAATATCGTGAAAAGACCGAGGTGCAGACAGGCGGCTTCAGCAAAGAGTCTATCC
TGCCCAAGAGGAACAGCGATAAGCTGATCGCCAGAAAGAAGGACTGGGACCCTAAGAAGTACGG
CGGCTTCGACAGCCCCACCGTGGCCTATTCTGTGCTGGTGGTGGCCAAAGTGGAAAAGGGCAAG
TCCAAGAAACTGAAGAGTGTGAAAGAGCTGCTGGGGATCACCATCATGGAAAGAAGCAGCTTCG
AGAAGAATCCCATCGACTTTCTGGAAGCCAAGGGCTACAAAGAAGTGAAAAAGGACCTGATCAT
CAAGCTGCCTAAGTACTCCCTGTTCGAGCTGGAAAACGGCCGGAAGAGAATGCTGGCCTCTGCC
GGCGAACTGCAGAAGGGAAACGAACTGGCCCTGCCCTCCAAATATGTGAACTTCCTGTACCTGG
CCAGCCACTATGAGAAGCTGAAGGGCTCCCCCGAGGATAATGAGCAGAAACAGCTGTTTGTGGA
ACAGCACAAGCACTACCTGGACGAGATCATCGAGCAGATCAGCGAGTTCTCCAAGAGAGTGATC
CTGGCCGACGCTAATCTGGACAAAGTGCTGTCCGCCTACAACAAGCACCGGGATAAGCCCATCA
GAGAGCAGGCCGAGAATATCATCCACCTGTTTACCCTGACCAATCTGGGAGCCCCTGCCGCCTT
CAAGTACTTTGACACCACCATCGACCGGAAGAGGTACACCAGCACCAAAGAGGTGCTGGACGCC
ACCCTGATCCACCAGAGCATCACCGGCCTGTACGAGACACGGATCGACCTGTCTCAGCTGGGAG
GCGAC 3.1.2 NLS

GGACCTAAGAAAAAGAGGAAGGTGGCGGCCGCT 3.1.3 VP64

GGACGGGCTGACGCATTGGACGATTTTGATCTGGATATGCTGGGAAGTGACGCCCTCGATGATT
TTGACCTTGACATGCTTGGTTCGGATGCCCTTGATGACTTTGACCTCGACATGCTCGGCAGTGA
CGCCCTTGATGATTTCGACCTGGACATGCTGATTAAC 3.2 dCas9(D10A, H840A)-NLS-P65

GACAAGAAGTACAGCATCGGCCTGGCCATCGGCACCAACTCTGTGGGCTGGGCCGTGATCACCG
ACGAGTACAAGGTGCCCAGCAAGAAATTCAAGGTGCTGGGCAACACCGACCGGCACAGCATCAA
GAAGAACCTGATCGGAGCCCTGCTGTTCGACAGCGGCGAAACAGCCGAGGCCACCCGGCTGAAG
AGAACCGCCAGAAGAAGATACACCAGACGGAAGAACCGGATCTGCTATCTGCAAGAGATCTTCA
GCAACGAGATGGCCAAGGTGGACGACAGCTTCTTCCACAGACTGGAAGAGTCCTTCCTGGTGGA
AGAGGATAAGAAGCACGAGCGGCACCCCATCTTCGGCAACATCGTGGACGAGGTGGCCTACCAC
GAGAAGTACCCCACCATCTACCACCTGAGAAAGAAACTGGTGGACAGCACCGACAAGGCCGACC

FIG. 80K

```
TGCGGCTGATCTATCTGGCCCTGGCCCACATGATCAAGTTCCGGGGCCACTTCCTGATCGAGGG
CGACCTGAACCCCGACAACAGCGACGTGGACAAGCTGTTCATCCAGCTGGTGCAGACCTACAAC
CAGCTGTTCGAGGAAAACCCCATCAACGCCAGCGGCGTGGACGCCAAGGCCATCCTGTCTGCCA
GACTGAGCAAGAGCAGACGGCTGGAAAATCTGATCGCCCAGCTGCCCGGCGAGAAGAAGAATGG
CCTGTTCGGCAACCTGATTGCCCTGAGCCTGGGCCTGACCCCCAACTTCAAGAGCAACTTCGAC
CTGGCCGAGGATGCCAAACTGCAGCTGAGCAAGGACACCTACGACGACGACCTGGACAACCTGC
TGGCCCAGATCGGCGACCAGTACGCCGACCTGTTTCTGGCCGCCAAGAACCTGTCCGACGCCAT
CCTGCTGAGCGACATCCTGAGAGTGAACACCGAGATCACCAAGGCCCCCCTGAGCGCCTCTATG
ATCAAGAGATACGACGAGCACCACCAGGACCTGACCCTGCTGAAAGCTCTCGTGCGGCAGCAGC
TGCCTGAGAAGTACAAAGAGATTTTCTTCGACCAGAGCAAGAACGGCTACGCCGGCTACATTGA
CGGCGGAGCCAGCCAGGAAGAGTTCTACAAGTTCATCAAGCCCATCCTGGAAAAGATGGACGGC
ACCGAGGAACTGCTCGTGAAGCTGAACAGAGAGGACCTGCTGCGGAAGCAGCGGACCTTCGACA
ACGGCAGCATCCCCCACCAGATCCACCTGGGAGAGCTGCACGCCATTCTGCGGCGGCAGGAAGA
TTTTTACCCATTCCTGAAGGACAACCGGGAAAAGATCGAGAAGATCCTGACCTTCCGCATCCCC
TACTACGTGGGCCCTCTGGCCAGGGGAAACAGCAGATTCGCCTGGATGACCAGAAAGAGCGAGG
AAACCATCACCCCCTGGAACTTCGAGGAAGTGGTGGACAAGGGCGCTTCCGCCCAGAGCTTCAT
CGAGCGGATGACCAACTTCGATAAGAACCTGCCCAACGAGAAGGTGCTGCCCAAGCACAGCCTG
CTGTACGAGTACTTCACCGTGTATAACGAGCTGACCAAAGTGAAATACGTGACCGAGGGAATGA
GAAAGCCCGCCTTCCTGAGCGGCGAGCAGAAAAAGGCCATCGTGGACCTGCTGTTCAAGACCAA
CCGGAAAGTGACCGTGAAGCAGCTGAAAGAGGACTACTTCAAGAAAATCGAGTGCTTCGACTCC
GTGGAAATCTCCGGCGTGGAAGATCGGTTCAACGCCTCCCTGGGCACATACCACGATCTGCTGA
AAATTATCAAGGACAAGGACTTCCTGGACAATGAGGAAAACGAGGACATTCTGGAAGATATCGT
GCTGACCCTGACACTGTTTGAGGACAGAGAGATGATCGAGGAACGGCTGAAAACCTATGCCCAC
CTGTTCGACGACAAAGTGATGAAGCAGCTGAAGCGGCGGAGATACACCGGCTGGGGCAGGCTGA
GCCGGAAGCTGATCAACGGCATCCGGGACAAGCAGTCCGGCAAGACAATCCTGGATTTCCTGAA
GTCCGACGGCTTCGCCAACAGAAACTTCATGCAGCTGATCCACGACGACAGCCTGACCTTTAAA
GAGGACATCCAGAAAGCCCAGGTGTCCGGCCAGGGCGATAGCCTGCACGAGCACATTGCCAATC
TGGCCGGCAGCCCCGCCATTAAGAAGGGCATCCTGCAGACAGTGAAGGTGGTGGACGAGCTCGT
GAAAGTGATGGGCCGGCACAAGCCCGAGAACATCGTGATCGAAATGGCCAGAGAGAACCAGACC
ACCCAGAAGGGACAGAAGAACAGCCGCGAGAGAATGAAGCGGATCGAAGAGGGCATCAAAGAGC
TGGGCAGCCAGATCCTGAAAGAACACCCCGTGGAAAACACCCAGCTGCAGAACGAGAAGCTGTA
CCTGTACTACCTGCAGAATGGGCGGGATATGTACGTGGACCAGGAACTGGACATCAACCGGCTG
TCCGACTACGATGTGGACGCTATCGTGCCTCAGAGCTTTCTGAAGGACGACTCCATCGACAACA
AGGTGCTGACCAGAAGCGACAAGAACCGGGGCAAGAGCGACAACGTGCCCTCCGAAGAGGTCGT
GAAGAAGATGAAGAACTACTGGCGGCAGCTGCTGAACGCCAAGCTGATTACCCAGAGAAAGTTC
GACAATCTGACCAAGGCCGAGAGAGGCGGCCTGAGCGAACTGGATAAGGCCGGCTTCATCAAGA
```

FIG. 80L

```
GACAGCTGGTGGAAACCCGGCAGATCACAAAGCACGTGGCACAGATCCTGGACTCCCGGATGAA
CACTAAGTACGACGAGAATGACAAGCTGATCCGGGAAGTGAAAGTGATCACCCTGAAGTCCAAG
CTGGTGTCCGATTTCCGGAAGGATTTCCAGTTTTACAAAGTGCGCGAGATCAACAACTACCAC
ACGCCCACGACGCCTACCTGAACGCCGTCGTGGGAACCGCCCTGATCAAAAGTACCCTAAGCT
GGAAAGCGAGTTCGTGTACGGCGACTACAAGGTGTACGACGTGCGGAAGATGATCGCCAAGAGC
GAGCAGGAAATCGGCAAGGCTACCGCCAAGTACTTCTTCTACAGCAACATCATGAACTTTTTCA
AGACCGAGATTACCCTGGCCAACGGCGAGATCCGGAAGCGGCCTCTGATCGAGACAAACGGCGA
AACCGGGGAGATCGTGTGGGATAAGGGCCGGGATTTTGCCACCGTGCGGAAAGTGCTGAGCATG
CCCCAAGTGAATATCGTGAAAAAGACCGAGGTGCAGACAGGCGGCTTCAGCAAAGAGTCTATCC
TGCCCAAGAGGAACAGCGATAAGCTGATCGCCAGAAAGAAGGACTGGGACCCTAAGAAGTACGG
CGGCTTCGACAGCCCCACCGTGGCCTATTCTGTGCTGGTGGTGGCCAAAGTGGAAAAGGGCAAG
TCCAAGAAACTGAAGAGTGTGAAAGAGCTGCTGGGGATCACCATCATGGAAAGAAGCAGCTTCG
AGAAGAATCCCATCGACTTTCTGGAAGCCAAGGGCTACAAAGAAGTGAAAAAGGACCTGATCAT
CAAGCTGCCTAAGTACTCCCTGTTCGAGCTGGAAAACGGCCGGAAGAGAATGCTGGCCTCTGCC
GGCGAACTGCAGAAGGGAAACGAACTGGCCCTGCCCTCCAAATATGTGAACTTCCTGTACCTGG
CCAGCCACTATGAGAAGCTGAAGGGCTCCCCCGAGGATAATGAGCAGAAACAGCTGTTTGTGGA
ACAGCACAAGCACTACCTGGACGAGATCATCGAGCAGATCAGCGAGTTCTCCAAGAGAGTGATC
CTGGCCGACGCTAATCTGGACAAAGTGCTGTCCGCCTACAACAAGCACGGGATAAGCCCATCA
GAGAGCAGGCCGAGAATATCATCCACCTGTTTACCCTGACCAATCTGGGAGCCCCTGCCGCCTT
CAAGTACTTTGACACCACCATCGACCGGAAGAGGTACACCAGCACCAAAGAGGTGCTGGACGCC
ACCCTGATCCACCAGAGCATCACCGGCCTGTACGAGACACGGATCGACCTGTCTCAGCTGGGAG
GCGACAGCGCTGGAGGAGGTGGAAGCGGAGGAGGAGGAAGCGGAGGAGGAGGTAGCGGACCTAA
GAAAAGAGGAAGGTGGCGGCCGCTGGATCCCCTTCAGGGCAGATCAGCAACCAGGCCCTGGCT
CTGGCCCCTAGCTCCGCTCCAGTGCTGGCCCAGACTATGGTGCCCTCTAGTGCTATGGTGCCTC
TGGCCCAGCCACCTGCTCCAGCCCCTGTGCTGACCCCAGGACCACCCCAGTCACTGAGCGCTCC
AGTGCCCAAGTCTACACAGGCCGGCGAGGGGACTCTGAGTGAAGCTCTGCTGCACCTGCAGTTC
GACGCTGATGAGGACCTGGGAGCTCTGCTGGGGAACAGCACCGATCCCGGAGTGTTCACAGATC
TGGCCTCCGTGGACAACTCTGAGTTTCAGCAGCTGCTGAATCAGGGCGTGTCCATGTCTCATAG
TACAGCCGAACCAATGCTGATGGAGTACCCCGAAGCCATTACCCGGCTGGTGACCGGCAGCCAG
CGGCCCCCGACCCCGCTCCAACTCCCCTGGGAACCAGCGGCCTGCCTAATGGGCTGTCCGGAG
ATGAAGACTTCTCAAGCATCGCTGATATGGACTTTAGTGCCCTGCTGTCACAGATTTCCTCTAG
TGGGCAG
```

FIG. 80M

3.2.1 dCas9(D10A, H840A)

```
GACAAGAAGTACAGCATCGGCCTGGCCATCGGCACCAACTCTGTGGGCTGGGCCGTGATCACCG
ACGAGTACAAGGTGCCCAGCAAGAAATTCAAGGTGCTGGGCAACACCGACCGGCACAGCATCAA
GAAGAACCTGATCGGAGCCCTGCTGTTCGACAGCGGCGAAACAGCCGAGGCCACCCGGCTGAAG
AGAACCGCCAGAAGAAGATACACCAGACGGAAGAACCGGATCTGCTATCTGCAAGAGATCTTCA
GCAACGAGATGGCCAAGGTGGACGACAGCTTCTTCCACAGACTGGAAGAGTCCTTCCTGGTGGA
AGAGGATAAGAAGCACGAGCGGCACCCCATCTTCGGCAACATCGTGGACGAGGTGGCCTACCAC
GAGAAGTACCCCACCATCTACCACCTGAGAAAGAAACTGGTGGACAGCACCGACAAGGCCGACC
TGCGGCTGATCTATCTGGCCCTGGCCCACATGATCAAGTTCCGGGGCCACTTCCTGATCGAGGG
CGACCTGAACCCCGACAACAGCGACGTGGACAAGCTGTTCATCCAGCTGGTGCAGACCTACAAC
CAGCTGTTCGAGGAAAACCCCATCAACGCCAGCGGCGTGGACGCCAAGGCCATCCTGTCTGCCA
GACTGAGCAAGAGCAGACGGCTGGAAAATCTGATCGCCCAGCTGCCCGGCGAGAAGAAGAATGG
CCTGTTCGGCAACCTGATTGCCCTGAGCCTGGGCCTGACCCCCAACTTCAAGAGCAACTTCGAC
CTGGCCGAGGATGCCAAACTGCAGCTGAGCAAGGACACCTACGACGACGACCTGGACAACCTGC
TGGCCCAGATCGGCGACCAGTACGCCGACCTGTTTCTGGCCGCCAAGAACCTGTCCGACGCCAT
CCTGCTGAGCGACATCCTGAGAGTGAACACCGAGATCACCAAGGCCCCCCTGAGCGCCTCTATG
ATCAAGAGATACGACGAGCACCACCAGGACCTGACCCTGCTGAAAGCTCTCGTGCGGCAGCAGC
TGCCTGAGAAGTACAAAGAGATTTTCTTCGACCAGAGCAAGAACGGCTACGCCGGCTACATTGA
CGGCGGAGCCAGCCAGGAAGAGTTCTACAAGTTCATCAAGCCCATCCTGGAAAAGATGGACGGC
ACCGAGGAACTGCTCGTGAAGCTGAACAGAGAGGACCTGCTGCGGAAGCAGCGGACCTTCGACA
ACGGCAGCATCCCCCACCAGATCCACCTGGGAGAGCTGCACGCCATTCTGCGGCGGCAGGAAGA
TTTTTACCCATTCCTGAAGGACAACCGGGAAAAGATCGAGAAGATCCTGACCTTCCGCATCCCC
TACTACGTGGGCCCTCTGGCCAGGGGAAACAGCAGATTCGCCTGGATGACCAGAAAGAGCGAGG
AAACCATCACCCCCTGGAACTTCGAGGAAGTGGTGGACAAGGGCGCTTCCGCCCAGAGCTTCAT
CGAGCGGATGACCAACTTCGATAAGAACCTGCCCAACGAGAAGGTGCTGCCCAAGCACAGCCTG
CTGTACGAGTACTTCACCGTGTATAACGAGCTGACCAAAGTGAAATACGTGACCGAGGGAATGA
GAAAGCCCGCCTTCCTGAGCGGCGAGCAGAAAAAGGCCATCGTGGACCTGCTGTTCAAGACCAA
CCGGAAAGTGACCGTGAAGCAGCTGAAAGAGGACTACTTCAAGAAAATCGAGTGCTTCGACTCC
GTGGAAATCTCCGGCGTGGAAGATCGGTTCAACGCCTCCCTGGGCACATACCACGATCTGCTGA
AAATTATCAAGGACAAGGACTTCCTGGACAATGAGGAAAACGAGGACATTCTGGAAGATATCGT
GCTGACCCTGACACTGTTTGAGGACAGAGAGATGATCGAGGAACGGCTGAAAACCTATGCCCAC
CTGTTCGACGACAAAGTGATGAAGCAGCTGAAGCGGCGGAGATACACCGGCTGGGGCAGGCTGA
GCCGGAAGCTGATCAACGGCATCCGGGACAAGCAGTCCGGCAAGACAATCCTGGATTTCCTGAA
GTCCGACGGCTTCGCCAACAGAAACTTCATGCAGCTGATCCACGACGACAGCCTGACCTTTAAA
GAGGACATCCAGAAAGCCCAGGTGTCCGGCCAGGGCGATAGCCTGCACGAGCACATTGCCAATC
```

FIG. 80N

```
TGGCCGGCAGCCCCGCCATTAAGAAGGGCATCCTGCAGACAGTGAAGGTGGTGGACGAGCTCGT
GAAAGTGATGGGCCGGCACAAGCCCGAGAACATCGTGATCGAAATGGCCAGAGAGAACCAGACC
ACCCAGAAGGGACAGAAGAACAGCCGCGAGAGAATGAAGCGGATCGAAGAGGGCATCAAAGAGC
TGGGCAGCCAGATCCTGAAAGAACACCCCGTGGAAAACACCCAGCTGCAGAACGAGAAGCTGTA
CCTGTACTACCTGCAGAATGGGCGGGATATGTACGTGGACCAGGAACTGGACATCAACCGGCTG
TCCGACTACGATGTGGACGCTATCGTGCCTCAGAGCTTTCTGAAGGACGACTCCATCGACAACA
AGGTGCTGACCAGAAGCGACAAGAACCGGGGCAAGAGCGACAACGTGCCCTCCGAAGAGGTCGT
GAAGAAGATGAAGAACTACTGGCGGCAGCTGCTGAACGCCAAGCTGATTACCCAGAGAAAGTTC
GACAATCTGACCAAGGCCGAGAGAGGCGGCCTGAGCGAACTGGATAAGGCCGGCTTCATCAAGA
GACAGCTGGTGGAAACCCGGCAGATCACAAAGCACGTGGCACAGATCCTGGACTCCCGGATGAA
CACTAAGTACGACGAGAATGACAAGCTGATCCGGGAAGTGAAAGTGATCACCCTGAAGTCCAAG
CTGGTGTCCGATTTCCGGAAGGATTTCCAGTTTTACAAAGTGCGCGAGATCAACAACTACCACC
ACGCCCACGACGCCTACCTGAACGCCGTCGTGGGAACCGCCCTGATCAAAAAGTACCCTAAGCT
GGAAAGCGAGTTCGTGTACGGCGACTACAAGGTGTACGACGTGCGGAAGATGATCGCCAAGAGC
GAGCAGGAAATCGGCAAGGCTACCGCCAAGTACTTCTTCTACAGCAACATCATGAACTTTTTCA
AGACCGAGATTACCCTGGCCAACGGCGAGATCCGGAAGCGGCCTCTGATCGAGACAAACGGCGA
AACCGGGGAGATCGTGTGGGATAAGGGCCGGGATTTTGCCACCGTGCGGAAAGTGCTGAGCATG
CCCCAAGTGAATATCGTGAAAAAGACCGAGGTGCAGACAGGCGGCTTCAGCAAAGAGTCTATCC
TGCCCAAGAGGAACAGCGATAAGCTGATCGCCAGAAAGAAGGACTGGGACCCTAAGAAGTACGG
CGGCTTCGACAGCCCCACCGTGGCCTATTCTGTGCTGGTGGTGGCCAAAGTGGAAAAGGGCAAG
TCCAAGAAACTGAAGAGTGTGAAAGAGCTGCTGGGGATCACCATCATGGAAGAAGCAGCTTCG
AGAAGAATCCCATCGACTTTCTGGAAGCCAAGGGCTACAAAGAAGTGAAAAAGGACCTGATCAT
CAAGCTGCCTAAGTACTCCCTGTTCGAGCTGGAAAACGGCCGGAAGAGAATGCTGGCCTCTGCC
GGCGAACTGCAGAAGGGAAACGAACTGGCCCTGCCCTCCAAATATGTGAACTTCCTGTACCTGG
CCAGCCACTATGAAGCTGAAGGGCTCCCCCGAGGATAATGAGCAGAAACAGCTGTTTGTGGA
ACAGCACAAGCACTACCTGGACGAGATCATCGAGCAGATCAGCGAGTTCTCCAAGAGAGTGATC
CTGGCCGACGCTAATCTGGACAAAGTGCTGTCCGCCTACAACAAGCACGGGATAAGCCCATCA
GAGAGCAGGCCGAGAATATCATCCACCTGTTTACCCTGACCAATCTGGGAGCCCCTGCCGCCTT
CAAGTACTTTGACACCACCATCGACCGGAAGAGGTACACCAGCACCAAAGAGGTGCTGGACGCC
ACCCTGATCCACCAGAGCATCACCGGCCTGTACGAGACACGGATCGACCTGTCTCAGCTGGGAG
GCGAC
```

3.2.2 NLS

GGACCTAAGAAAAAGAGGAAGGTGGCGGCCGCT

CCTTCAGGGCAGATCAGCAACCAGGCCCTGGCTCTGGCCCCTAGCTCCGCTCCAGTGCTGGCCC
AGACTATGGTGCCCTCTAGTGCTATGGTGCCTCTGGCCCAGCCACCTGCTCCAGCCCCTGTGCT
GACCCCAGGACCACCCCAGTCACTGAGCGCTCCAGTGCCCAAGTCTACACAGGCCGGCGAGGGG
ACTCTGAGTGAAGCTCTGCTGCACCTGCAGTTCGACGCTGATGAGGACCTGGGAGCTCTGCTGG
GGAACAGCACCGATCCCGGAGTGTTCACAGATCTGGCCTCCGTGGACAACTCTGAGTTTCAGCA
GCTGCTGAATCAGGGCGTGTCCATGTCTCATAGTACAGCCGAACCAATGCTGATGGAGTACCCC
GAAGCCATTACCCGGCTGGTGACCGGCAGCCAGCGGCCCCCCGACCCCGCTCCAACTCCCCTGG
GAACCAGCGGCCTGCCTAATGGGCTGTCCGGAGATGAAGACTTCTCAAGCATCGCTGATATGGA
CTTTAGTGCCCTGCTGTCACAGATTTCCTCTAGTGGGCAG

4 Lentiviral Vectors

4.1 pFUGW-EF1α-NLS(SV40)-dCas9(N863)-NLS-VP64-P2A-Blast

TGCAAAGATGGATAAAGTTTTAAACAGAGAGGAATCTTTGCAGCTAATGGACCTTCTAGGTCTT
GAAGGAGTGGGAATTGGCTCCGGTGCCCGTCAGTGGGCAGAGCGCACATCGCCCACAGTCCCC
GAGAAGTTGGGGGGAGGGGTCGGCAATTGAACCGGTGCCTAGAGAAGGTGGCGCGGGGTAAACT
GGGAAAGTGATGTCGTGTACTGGCTCCGCCTTTTTCCCGAGGGTGGGGGAGAACCGTATATAAG
TGCAGTAGTCGCCGTGAACGTTCTTTTTCGCAACGGGTTTGCCGCCAGAACACAGGTAAGTGCC
GTGTGTGGTTCCCGCGGGCCTGGCCTCTTTACGGGTTATGGCCCTTGCGTGCCTTGAATTACTT
CCACTGGCTGCAGTACGTGATTCTTGATCCCGAGCTTCGGGTTGGAAGTGGGTGGGAGAGTTCG
AGGCCTTGCGCTTAAGGAGCCCCTTCGCCTCGTGCTTGAGTTGAGGCCTGGCCTGGGCGCTGGG
GCCGCCGCGTGCGAATCTGGTGGCACCTTCGCGCCTGTCTCGCTGCTTTCGATAAGTCTCTAGC
CATTTAAAATTTTTGATGACCTGCTGCGACGCTTTTTTCTGGCAAGATAGTCTTGTAAATGCG
GGCCAAGATCTGCACACTGGTATTTCGGTTTTTGGGGCCGCGGGCGGCGACGGGGCCCGTGCGT
CCCAGCGCACATGTTCGGCGAGGCGGGGCCTGCGAGCGCGGCCACCGAGAATCGGACGGGGGTA
GTCTCAAGCTGGCCGGCCTGCTCTGGTGCCTGGCCTCGCGCCGCCGTGTATCGCCCCGCCCTGG
GCGGCAAGGCTGGCCCGGTCGGCACCAGTTGCGTGAGCGGAAAGATGGCCGCTTCCCGGCCCTG
CTGCAGGGAGCTCAAAATGGAGGACGCGGCGCTCGGGAGAGCGGGCGGGTGAGTCACCCACACA
AAGGAAAAGGGCCTTTCCGTCCTCAGCCGTCGCTTCATGTGACTCCACGGAGTACCGGGCGCCG
TCCAGGCACCTCGATTAGTTCTCGAGCTTTTGGAGTACGTCGTCTTTAGGTTGGGGGGAGGGGT
TTTATGCGATGAGTTTCCCCACACTGAGTGGGTGGAGACTGAAGTTAGGCCAGCTTGGCACTT
GATGTAATTCTCCTTGGAATTTGCCCTTTTTGAGTTTGGATCTTGGTTCATTCTCAAGCCTCAG

FIG. 80P

```
ACAGTGGTTCAAAGTTTTTTTCTTCCATTTCAGGTGTCGTGACGTACGGCCACCCATGAGCCCC
AAGAAGAAGAGAAAGGTGGAGGCCAGCGACAAGAAGTACAGCATCGGCCTGGCCATCGGCACCA
ACTCTGTGGGCTGGGCCGTGATCACCGACGAGTACAAGGTGCCCAGCAAGAAATTCAAGGTGCT
GGGCAACACCGACCGGCACAGCATCAAGAAGAACCTGATCGGAGCCCTGCTGTTCGACAGCGGC
GAAACAGCCGAGGCCACCCGGCTGAAGAGAACCGCCAGAAGAAGATACACCAGACGGAAGAACC
GGATCTGCTATCTGCAAGAGATCTTCAGCAACGAGATGGCCAAGGTGGACGACAGCTTCTTCCA
CAGACTGGAAGAGTCCTTCCTGGTGGAAGAGGATAAGAAGCACGAGCGGCACCCCATCTTCGGC
AACATCGTGGACGAGGTGGCCTACCACGAGAAGTACCCCACCATCTACCACCTGAGAAAGAAAC
TGGTGGACAGCACCGACAAGGCCGACCTGCGGCTGATCTATCTGGCCCTGGCCCACATGATCAA
GTTCCGGGGCCACTTCCTGATCGAGGGCGACCTGAACCCCGACAACAGCGACGTGGACAAGCTG
TTCATCCAGCTGGTGCAGACCTACAACCAGCTGTTCGAGGAAAACCCCATCAACGCCAGCGGCG
TGGACGCCAAGGCCATCCTGTCTGCCAGACTGAGCAAGAGCAGACGGCTGGAAAATCTGATCGC
CCAGCTGCCCGGCGAGAAGAAGAATGGCCTGTTCGGCAACCTGATTGCCCTGAGCCTGGGCCTG
ACCCCAACTTCAAGAGCAACTTCGACCTGGCCGAGGATGCCAAACTGCAGCTGAGCAAGGACA
CCTACGACGACGACCTGGACAACCTGCTGGCCCAGATCGGCGACCAGTACGCCGACCTGTTTCT
GGCCGCCAAGAACCTGTCCGACGCCATCCTGCTGAGCGACATCCTGAGAGTGAACACCGAGATC
ACCAAGGCCCCCCTGAGCGCCTCTATGATCAAGAGATACGACGAGCACCACCAGGACCTGACCC
TGCTGAAAGCTCTCGTGCGGCAGCAGCTGCCTGAGAAGTACAAAGAGATTTTCTTCGACCAGAG
CAAGAACGGCTACGCCGGCTACATTGACGGCGGAGCCAGCCAGGAAGAGTTCTACAAGTTCATC
AAGCCCATCCTGGAAAAGATGGACGGCACCGAGGAACTGCTCGTGAAGCTGAACAGAGAGGACC
TGCTGCGGAAGCAGCGGACCTTCGACAACGGCAGCATCCCCCACCAGATCCACCTGGGAGAGCT
GCACGCCATTCTGCGGCGGCAGGAAGATTTTTACCCATTCCTGAAGGACAACCGGGAAAAGATC
GAGAAGATCCTGACCTTCCGCATCCCCTACTACGTGGGCCCTCTGGCCAGGGGAAACAGCAGAT
TCGCCTGGATGACCAGAAAGAGCGAGGAAACCATCACCCCCTGGAACTTCGAGGAAGTGGTGGA
CAAGGGCGCTTCCGCCCAGAGCTTCATCGAGCGGATGACCAACTTCGATAAGAACCTGCCCAAC
GAGAAGGTGCTGCCCAAGCACAGCCTGCTGTACGAGTACTTCACCGTGTATAACGAGCTGACCA
AAGTGAAATACGTGACCGAGGGAATGAGAAAGCCCGCCTTCCTGAGCGGCGAGCAGAAAAAGGC
CATCGTGGACCTGCTGTTCAAGACCAACCGGAAAGTGACCGTGAAGCAGCTGAAAGAGGACTAC
TTCAAGAAAATCGAGTGCTTCGACTCCGTGGAAATCTCCGGCGTGGAAGATCGGTTCAACGCCT
CCCTGGGCACATACCACGATCTGCTGAAAATTATCAAGGACAAGGACTTCCTGGACAATGAGGA
AAACGAGGACATTCTGGAAGATATCGTGCTGACCCTGACACTGTTTGAGGACAGAGAGATGATC
GAGGAACGGCTGAAAACCTATGCCCACCTGTTCGACGACAAAGTGATGAAGCAGCTGAAGCGGC
GGAGATACACCGGCTGGGGCAGGCTGAGCCGGAAGCTGATCAACGGCATCCGGGACAAGCAGTC
CGGCAAGACAATCCTGGATTTCCTGAAGTCCGACGGCTTCGCCAACAGAAACTTCATGCAGCTG
ATCCACGACGACAGCCTGACCTTTAAAGAGGACATCCAGAAAGCCCAGGTGTCCGGCCAGGGCG
ATAGCCTGCACGAGCACATTGCCAATCTGGCCGGCAGCCCCGCCATTAAGAAGGGCATCCTGCA
```

FIG. 80Q

```
GACAGTGAAGGTGGTGGACGAGCTCGTGAAAGTGATGGGCCGGCACAAGCCCGAGAACATCGTG
ATCGAAATGGCCAGAGAGAACCAGACCACCCAGAAGGGACAGAAGAACAGCCGCGAGAGAATGA
AGCGGATCGAAGAGGGCATCAAAGAGCTGGGCAGCCAGATCCTGAAAGAACACCCCGTGGAAAA
CACCCAGCTGCAGAACGAGAAGCTGTACCTGTACTACCTGCAGAATGGGCGGGATATGTACGTG
GACCAGGAACTGGACATCAACCGGCTGTCCGACTACGATGTGGACCACATCGTGCCTCAGAGCT
TTCTGAAGGACGACTCCATCGACAACAAGGTGCTGACCAGAAGCGACAAGGCCCGGGGCAAGAG
CGACAACGTGCCCTCCGAAGAGGTCGTGAAGAAGATGAAGAACTACTGGCGGCAGCTGCTGAAC
GCCAAGCTGATTACCCAGAGAAAGTTCGACAATCTGACCAAGGCCGAGAGAGGCGGCCTGAGCG
AACTGGATAAGGCCGGCTTCATCAAGAGACAGCTGGTGGAAACCCGGCAGATCACAAAGCACGT
GGCACAGATCCTGGACTCCCGGATGAACACTAAGTACGACGAGAATGACAAGCTGATCCGGGAA
GTGAAAGTGATCACCCTGAAGTCCAAGCTGGTGTCCGATTTCCGGAAGGATTTCCAGTTTTACA
AAGTGCGCGAGATCAACAACTACCACCACGCCCACGACGCCTACCTGAACGCCGTCGTGGGAAC
CGCCCTGATCAAAAAGTACCCTAAGCTGGAAAGCGAGTTCGTGTACGGCGACTACAAGGTGTAC
GACGTGCGGAAGATGATCGCCAAGAGCGAGCAGGAAATCGGCAAGGCTACCGCCAAGTACTTCT
TCTACAGCAACATCATGAACTTTTTCAAGACCGAGATTACCCTGGCCAACGGCGAGATCCGGAA
GCGGCCTCTGATCGAGACAAACGGCGAAACCGGGGAGATCGTGTGGGATAAGGGCCGGGATTTT
GCCACCGTGCGGAAAGTGCTGAGCATGCCCCAAGTGAATATCGTGAAAAAGACCGAGGTGCAGA
CAGGCGGCTTCAGCAAGGAGTCTATCCTGCCCAAGAGGAACAGCGATAAGCTGATCGCCAGAAA
GAAGGACTGGGACCCTAAGAAGTACGGCGGCTTCGACAGCCCCACCGTGGCCTATTCTGTGCTG
GTGGTGGCCAAAGTGGAAAAGGGCAAGTCCAAGAAACTGAAGAGTGTGAAAGAGCTGCTGGGGA
TCACCATCATGGAAAGAAGCAGCTTCGAGAAGAATCCCATCGACTTTCTGGAAGCCAAGGGCTA
CAAAGAAGTGAAAAAGGACCTGATCATCAAGCTGCCTAAGTACTCCCTGTTCGAGCTGGAAAAC
GGCCGGAAGAGAATGCTGGCCTCTGCCGGCGAACTGCAGAAGGGAAACGAACTGGCCCTGCCCT
CCAAATATGTGAACTTCCTGTACCTGGCCAGCCACTATGAAGCTGAAGGGCTCCCCCGAGGA
TAATGAGCAGAAACAGCTGTTTGTGGAACAGCACAAGCACTACCTGGACGAGATCATCGAGCAG
ATCAGCGAGTTCTCCAAGAGAGTGATCCTGGCCGACGCTAATCTGGACAAAGTGCTGTCCGCCT
ACAACAAGCACCGGGATAAGCCCATCAGAGAGCAGGCCGAGAATATCATCCACCTGTTTACCCT
GACCAATCTGGGAGCCCCTGCCGCCTTCAAGTACTTTGACACCACCATCGACCGGAAGAGGTAC
ACCAGCACCAAAGAGGTGCTGGACGCCACCCTGATCCACCAGAGCATCACCGGCCTGTACGAGA
CACGGATCGACCTGTCTCAGCTGGGAGGCGACAGCGCTGGAGGAGGTGGAAGCGGAGGAGGAGG
AAGCGGAGGAGGAGGTAGCGGACCTAAGAAAAAGAGGAAGGTGGCGGCCGCTGGATCCGGACGG
GCTGACGCATTGGACGATTTTGATCTGGATATGCTGGGAAGTGACGCCCTCGATGATTTTGACC
TTGACATGCTTGGTTCGGATGCCCTTGATGACTTTGACCTCGACATGCTCGGCAGTGACGCCCT
TGATGATTTCGACCTGGACATGCTGATTAACTGTACAGGCAGTGGAGAGGGCAGAGGAAGTCTG
CTAACATGCGGTGACGTCGAGGAGAATCCTGGCCCAATGGCCAAGCCTTTGTCTCAAGAAGAAT
CCACCCTCATTGAAAGAGCAACGGCTACAATCAACAGCATCCCCATCTCTGAAGACTACAGCGT
```

FIG. 80R

```
CGCCAGCGCAGCTCTCTCTAGCGACGGCCGCATCTTCACTGGTGTCAATGTATATCATTTTACT
GGGGGACCTTGTGCAGAACTCGTGGTGCTGGGCACTGCTGCTGCTGCGGCAGCTGGCAACCTGA
CTTGTATCGTCGCGATCGGAAATGAGAACAGGGGCATCTTGAGCCCCTGCGGACGGTGCCGACA
GGTGCTTCTCGATCTGCATCCTGGGATCAAAGCCATAGTGAAGGACAGTGATGGACAGCCGACG
GCAGTTGGGATTCGTGAATTGCTGCCCTCTGGTTATGTGTGGGAGGGCTAA
```

4.1.1 EF1α

```
TGCAAAGATGGATAAAGTTTTAAACAGAGAGGAATCTTTGCAGCTAATGGACCTTCTAGGTCTT
GAAAGGAGTGGGAATTGGCTCCGGTGCCCGTCAGTGGGCAGAGCGCACATCGCCCACAGTCCCC
GAGAAGTTGGGGGGAGGGGTCGGCAATTGAACCGGTGCCTAGAGAAGGTGGCGCGGGGTAAACT
GGGAAAGTGATGTCGTGTACTGGCTCCGCCTTTTCCCGAGGGTGGGGGAGAACCGTATATAAG
TGCAGTAGTCGCCGTGAACGTTCTTTTTCGCAACGGGTTTGCCGCCAGAACACAGGTAAGTGCC
GTGTGTGGTTCCCGCGGGCCTGGCCTCTTTACGGGTTATGGCCCTTGCGTGCCTTGAATTACTT
CCACTGGCTGCAGTACGTGATTCTTGATCCCGAGCTTCGGGTTGGAAGTGGGTGGGAGAGTTCG
AGGCCTTGCGCTTAAGGAGCCCCTTCGCCTCGTGCTTGAGTTGAGGCCTGGCCTGGGCGCTGGG
GCCGCCGCGTGCGAATCTGGTGGCACCTTCGCGCCTGTCTCGCTGCTTTCGATAAGTCTCTAGC
CATTTAAAATTTTTGATGACCTGCTGCGACGCTTTTTTTCTGGCAAGATAGTCTTGTAAATGCG
GGCCAAGATCTGCACACTGGTATTTCGGTTTTTGGGGCCGCGGGCGGCGACGGGGCCCGTGCGT
CCCAGCGCACATGTTCGGCGAGGCGGGGCCTGCGAGCGCGGCCACCGAGAATCGGACGGGGGTA
GTCTCAAGCTGGCCGGCCTGCTCTGGTGCCTGGCCTCGCGCCGCCGTGTATCGCCCCGCCCTGG
GCGGCAAGGCTGGCCCGGTCGGCACCAGTTGCGTGAGCGGAAAGATGGCCGCTTCCCGGCCCTG
CTGCAGGGAGCTCAAAATGGAGGACGCGGCGCTCGGGAGAGCGGGCGGGTGAGTCACCCACACA
AAGGAAAAGGGCCTTTCCGTCCTCAGCCGTCGCTTCATGTGACTCCACGGAGTACCGGGCGCCG
TCCAGGCACCTCGATTAGTTCTCGAGCTTTTGGAGTACGTCGTCTTTAGGTTGGGGGGAGGGGT
TTTATGCGATGGAGTTTCCCCACACTGAGTGGGTGGAGACTGAAGTTAGGCCAGCTTGGCACTT
GATGTAATTCTCCTTGGAATTTGCCCTTTTTGAGTTTGGATCTTGGTTCATTCTCAAGCCTCAG
ACAGTGGTTCAAAGTTTTTTTCTTCCATTTCAGGTGTCGTGA
```

4.1.2 NLS(SV40)

```
ATGAGCCCCAAGAAGAAGAGAAAGGTGGAGGCCAGC
```

FIG. 80S

4.1.3 dCas9(N863)

GACAAGAAGTACAGCATCGGCCTGGCCATCGGCACCAACTCTGTGGGCTGGGCCGTGATCACCG
ACGAGTACAAGGTGCCCAGCAAGAAATTCAAGGTGCTGGGCAACACCGACCGGCACAGCATCAA
GAAGAACCTGATCGGAGCCCTGCTGTTCGACAGCGGCGAAACAGCCGAGGCCACCCGGCTGAAG
AGAACCGCCAGAAGAAGATACACCAGACGGAAGAACCGGATCTGCTATCTGCAAGAGATCTTCA
GCAACGAGATGGCCAAGGTGGACGACAGCTTCTTCCACAGACTGGAAGAGTCCTTCCTGGTGGA
AGAGGATAAGAAGCACGAGCGGCACCCCATCTTCGGCAACATCGTGGACGAGGTGGCCTACCAC
GAGAAGTACCCCACCATCTACCACCTGAGAAAGAAACTGGTGGACAGCACCGACAAGGCCGACC
TGCGGCTGATCTATCTGGCCCTGGCCCACATGATCAAGTTCCGGGGCCACTTCCTGATCGAGGG
CGACCTGAACCCCGACAACAGCGACGTGGACAAGCTGTTCATCCAGCTGGTGCAGACCTACAAC
CAGCTGTTCGAGGAAAACCCCATCAACGCCAGCGGCGTGGACGCCAAGGCCATCCTGTCTGCCA
GACTGAGCAAGAGCAGACGGCTGGAAAATCTGATCGCCCAGCTGCCCGGCGAGAAGAAGAATGG
CCTGTTCGGCAACCTGATTGCCCTGAGCCTGGGCCTGACCCCCAACTTCAAGAGCAACTTCGAC
CTGGCCGAGGATGCCAAACTGCAGCTGAGCAAGGACACCTACGACGACGACCTGGACAACCTGC
TGGCCCAGATCGGCGACCAGTACGCCGACCTGTTTCTGGCCGCCAAGAACCTGTCCGACGCCAT
CCTGCTGAGCGACATCCTGAGAGTGAACACCGAGATCACCAAGGCCCCCCTGAGCGCCTCTATG
ATCAAGAGATACGACGAGCACCACCAGGACCTGACCCTGCTGAAAGCTCTCGTGCGGCAGCAGC
TGCCTGAGAAGTACAAAGAGATTTTCTTCGACCAGAGCAAGAACGGCTACGCCGGCTACATTGA
CGGCGGAGCCAGCCAGGAAGAGTTCTACAAGTTCATCAAGCCCATCCTGGAAAAGATGGACGGC
ACCGAGGAACTGCTCGTGAAGCTGAACAGAGAGGACCTGCTGCGGAAGCAGCGGACCTTCGACA
ACGGCAGCATCCCCCACCAGATCCACCTGGGAGAGCTGCACGCCATTCTGCGGCGGCAGGAAGA
TTTTTACCCATTCCTGAAGGACAACCGGGAAAAGATCGAGAAGATCCTGACCTTCCGCATCCCC
TACTACGTGGGCCCTCTGGCCAGGGGAAACAGCAGATTCGCCTGGATGACCAGAAAGAGCGAGG
AAACCATCACCCCCTGGAACTTCGAGGAAGTGGTGGACAAGGGCGCTTCCGCCCAGAGCTTCAT
CGAGCGGATGACCAACTTCGATAAGAACCTGCCCAACGAGAAGGTGCTGCCCAAGCACAGCCTG
CTGTACGAGTACTTCACCGTGTATAACGAGCTGACCAAAGTGAAATACGTGACCGAGGGAATGA
GAAAGCCCGCCTTCCTGAGCGGCGAGCAGAAAAAGGCCATCGTGGACCTGCTGTTCAAGACCAA
CCGGAAAGTGACCGTGAAGCAGCTGAAAGAGGACTACTTCAAGAAAATCGAGTGCTTCGACTCC
GTGGAAATCTCCGGCGTGGAAGATCGGTTCAACGCCTCCCTGGGCACATACCACGATCTGCTGA
AAATTATCAAGGACAAGGACTTCCTGGACAATGAGGAAAACGAGGACATTCTGGAAGATATCGT
GCTGACCCTGACACTGTTTGAGGACAGAGAGATGATCGAGGAACGGCTGAAAACCTATGCCCAC
CTGTTCGACGACAAAGTGATGAAGCAGCTGAAGCGGCGGAGATACACCGGCTGGGGCAGGCTGA
GCCGGAAGCTGATCAACGGCATCCGGGACAAGCAGTCCGGCAAGACAATCCTGGATTTCCTGAA
GTCCGACGGCTTCGCCAACAGAAACTTCATGCAGCTGATCCACGACGACAGCCTGACCTTTAAA
GAGGACATCCAGAAAGCCCAGGTGTCCGGCCAGGGCGATAGCCTGCACGAGCACATTGCCAATC

FIG. 80T

TGGCCGGCAGCCCCGCCATTAAGAAGGGCATCCTGCAGACAGTGAAGGTGGTGGACGAGCTCGT
GAAAGTGATGGGCCGGCACAAGCCCGAGAACATCGTGATCGAAATGGCCAGAGAGAACCAGACC
ACCCAGAAGGGACAGAAGAACAGCCGCGAGAGAATGAAGCGGATCGAAGAGGGCATCAAAGAGC
TGGGCAGCCAGATCCTGAAAGAACACCCCGTGGAAAACACCCAGCTGCAGAACGAGAAGCTGTA
CCTGTACTACCTGCAGAATGGGCGGGATATGTACGTGGACCAGGAACTGGACATCAACCGGCTG
TCCGACTACGATGTGGACCACATCGTGCCTCAGAGCTTTCTGAAGGACGACTCCATCGACAACA
AGGTGCTGACCAGAAGCGACAAGGCCCGGGGCAAGAGCGACAACGTGCCCTCCGAAGAGGTCGT
GAAGAAGATGAAGAACTACTGGCGGCAGCTGCTGAACGCCAAGCTGATTACCCAGAGAAAGTTC
GACAATCTGACCAAGGCCGAGAGAGGCGGCCTGAGCGAACTGGATAAGGCCGGCTTCATCAAGA
GACAGCTGGTGGAAACCCGGCAGATCACAAAGCACGTGGCACAGATCCTGGACTCCCGGATGAA
CACTAAGTACGACGAGAATGACAAGCTGATCCGGGAAGTGAAAGTGATCACCCTGAAGTCCAAG
CTGGTGTCCGATTTCCGGAAGGATTTCCAGTTTTACAAAGTGCGCGAGATCAACAACTACCACC
ACGCCCACGACGCCTACCTGAACGCCGTCGTGGGAACCGCCCTGATCAAAAAGTACCCTAAGCT
GGAAAGCGAGTTCGTGTACGGCGACTACAAGGTGTACGACGTGCGGAAGATGATCGCCAAGAGC
GAGCAGGAAATCGGCAAGGCTACCGCCAAGTACTTCTTCTACAGCAACATCATGAACTTTTTCA
AGACCGAGATTACCCTGGCCAACGGCGAGATCCGGAAGCGGCCTCTGATCGAGACAAACGGCGA
AACCGGGGAGATCGTGTGGGATAAGGGCCGGGATTTTGCCACCGTGCGGAAAGTGCTGAGCATG
CCCCAAGTGAATATCGTGAAAAAGACCGAGGTGCAGACAGGCGGCTTCAGCAAAGAGTCTATCC
TGCCCAAGAGGAACAGCGATAAGCTGATCGCCAGAAAGAAGGACTGGGACCCTAAGAAGTACGG
CGGCTTCGACAGCCCCACCGTGGCCTATTCTGTGCTGGTGGTGGCCAAAGTGGAAAAGGGCAAG
TCCAAGAAACTGAAGAGTGTGAAAGAGCTGCTGGGGATCACCATCATGGAAAGAAGCAGCTTCG
AGAAGAATCCCATCGACTTTCTGGAAGCCAAGGGCTACAAAGAAGTGAAAAAGGACCTGATCAT
CAAGCTGCCTAAGTACTCCCTGTTCGAGCTGGAAAACGGCCGGAAGAGAATGCTGGCCTCTGCC
GGCGAACTGCAGAAGGGAAACGAACTGGCCCTGCCCTCCAAATATGTGAACTTCCTGTACCTGG
CCAGCCACTATGAAGCTGAAGGGCTCCCCGAGGATAATGAGCAGAAACAGCTGTTTGTGGA
ACAGCACAAGCACTACCTGGACGAGATCATCGAGCAGATCAGCGAGTTCTCCAAGAGAGTGATC
CTGGCCGACGCTAATCTGGACAAAGTGCTGTCCGCCTACAACAAGCACGGGATAAGCCCATCA
GAGAGCAGGCCGAGAATATCATCCACCTGTTTACCCTGACCAATCTGGGAGCCCCTGCCGCCTT
CAAGTACTTTGACACCACCATCGACCGGAAGAGGTACACCAGCACCAAAGAGGTGCTGGACGCC
ACCCTGATCCACCAGAGCATCACCGGCCTGTACGAGACACGGATCGACCTGTCTCAGCTGGGAG
GCGAC 4.1.4 NLS

GGACCTAAGAAAAAGAGGAAGGTGGCGGCCGCT

4.1.5 VP64

GGACGGGCTGACGCATTGGACGATTTTGATCTGGATATGCTGGGAAGTGACGCCCTCGATGATT
TTGACCTTGACATGCTTGGTTCGGATGCCCTTGATGACTTTGACCTCGACATGCTCGGCAGTGA
CGCCCTTGATGATTTCGACCTGGACATGCTGATTAAC

4.1.6 P2A

GGCAGTGGAGAGGGCAGAGGAAGTCTGCTAACATGCGGTGACGTCGAGGAGAATCCTGGCCCA

4.1.7 Blast

ATGGCCAAGCCTTTGTCTCAAGAAGAATCCACCCTCATTGAAAGAGCAACGGCTACAATCAACA
GCATCCCCATCTCTGAAGACTACAGCGTCGCCAGCGCAGCTCTCTCTAGCGACGGCCGCATCTT
CACTGGTGTCAATGTATATCATTTTACTGGGGGACCTTGTGCAGAACTCGTGGTGCTGGGCACT
GCTGCTGCTGCGGCAGCTGGCAACCTGACTTGTATCGTCGCGATCGGAAATGAGAACAGGGGCA
TCTTGAGCCCCTGCGGACGGTGCCGACAGGTGCTTCTCGATCTGCATCCTGGGATCAAAGCCAT
AGTGAAGGACAGTGATGGACAGCCGACGGCAGTTGGGATTCGTGAATTGCTGCCCTCTGGTTAT
GTGTGGGAGGGCTAA

4.2 pFUGW-EF1α-MS2-NLS-p65-HSF1-P2A-Hygro

TGCAAAGATGGATAAAGTTTTAAACAGAGAGGAATCTTTGCAGCTAATGGACCTTCTAGGTCTT
GAAAGGAGTGGGAATTGGCTCCGGTGCCCGTCAGTGGGCAGAGCGCACATCGCCCACAGTCCCC
GAGAAGTTGGGGGGAGGGGTCGGCAATTGAACCGGTGCCTAGAGAAGGTGGCGCGGGGTAAACT
GGGAAAGTGATGTCGTGTACTGGCTCCGCCTTTTTCCCGAGGGTGGGGGAGAACCGTATATAAG
TGCAGTAGTCGCCGTGAACGTTCTTTTTCGCAACGGGTTTGCCGCCAGAACACAGGTAAGTGCC
GTGTGTGGTTCCCGCGGGCCTGGCCTCTTTACGGGTTATGGCCCTTGCGTGCCTTGAATTACTT
CCACCTGGCTGCAGTACGTGATTCTTGATCCCGAGCTTCGGGTTGGAAGTGGGTGGGAGAGTTC
GAGGCCTTGCGCTTAAGGAGCCCCTTCGCCTCGTGCTTGAGTTGAGGCCTGGCCTGGGCGCTGG
GGCCGCCGCGTGCGAATCTGGTGGCACCTTCGCGCCTGTCTCGCTGCTTTCGATAAGTCTCTAG
CCATTTAAAATTTTTGATGACCTGCTGCGACGCTTTTTTTCTGGCAAGATAGTCTTGTAAATGC
GGGCCAAGATCTGCACACTGGTATTTCGGTTTTTGGGGCCGCGGGCGGCGACGGGGCCCGTGCG
TCCAGCGCACATGTTCGGCGAGGCGGGGCCTGCGAGCGCGGCCACCGAGAATCGGACGGGGGT
AGTCTCAAGCTGGCCGGCCTGCTCTGGTGCCTGGCCTCGCGCCGCCGTGTATCGCCCCGCCCTG
GGCGGCAAGGCTGGCCCGGTCGGCACCAGTTGCGTGAGCGGAAAGATGGCCGCTTCCCGGCCCT
GCTGCAGGGAGCTCAAAATGGAGGACGCGGCGCTCGGGAGAGCGGGCGGGTGAGTCACCCACAC

FIG. 80V

```
AAAGGAAAAGGGCCTTTCCGTCCTCAGCCGTCGCTTCATGTGACTCCACGGAGTACCGGGCGCC
GTCCAGGCACCTCGATTAGTTCTCGAGCTTTTGGAGTACGTCGTCTTTAGGTTGGGGGGAGGGG
TTTTATGCGATGGAGTTTCCCCACACTGAGTGGGTGGAGACTGAAGTTAGGCCAGCTTGGCACT
TGATGTAATTCTCCTTGGAATTTGCCCTTTTGAGTTTGGATCTTGGTTCATTCTCAAGCCTCA
GACAGTGGTTCAAAGTTTTTTTCTTCCATTTCAGGTGTCGTGACGTACGGCCACCATGGCTTCA
AACTTTACTCAGTTCGTGCTCGTGGACAATGGTGGGACAGGGGATGTGACAGTGGCTCCTTCTA
ATTTCGCTAATGGGGTGGCAGAGTGGATCAGCTCCAACTCACGGAGCCAGGCCTACAAGGTGAC
ATGCAGCGTCAGGCAGTCTAGTGCCCAGAAGAGAAAGTATACCATCAAGGTGGAGGTCCCCAAA
GTGGCTACCCAGACAGTGGGCGGAGTCGAACTGCCTGTCGCCGCTTGGAGGTCCTACCTGAACA
TGGAGCTCACTATCCCAATTTTCGCTACCAATTCTGACTGTGAACTCATCGTGAAGGCAATGCA
GGGGCTCCTCAAAGACGGTAATCCTATCCCTTCCGCCATCGCCGCTAACTCAGGTATCTACAGC
GCTGGAGGAGGTGGAAGCGGAGGAGGAGGAAGCGGAGGAGGAGGTAGCGGACCTAAGAAAAAGA
GGAAGGTGGCGGCCGCTGGATCCCCTTCAGGGCAGATCAGCAACCAGGCCCTGGCTCTGGCCCC
TAGCTCCGCTCCAGTGCTGGCCCAGACTATGGTGCCCTCTAGTGCTATGGTGCCTCTGGCCCAG
CCACCTGCTCCAGCCCCTGTGCTGACCCCAGGACCACCCCAGTCACTGAGCGCTCCAGTGCCCA
AGTCTACACAGGCCGGCGAGGGGACTCTGAGTGAAGCTCTGCTGCACCTGCAGTTCGACGCTGA
TGAGGACCTGGGAGCTCTGCTGGGGAACAGCACCGATCCCGGAGTGTTCACAGATCTGGCCTCC
GTGGACAACTCTGAGTTTCAGCAGCTGCTGAATCAGGGCGTGTCCATGTCTCATAGTACAGCCG
AACCAATGCTGATGGAGTACCCCGAAGCCATTACCCGGCTGGTGACCGGCAGCCAGCGGCCCCC
CGACCCCGCTCCAACTCCCCTGGGAACCAGCGGCCTGCCTAATGGGCTGTCCGGAGATGAAGAC
TTCTCAAGCATCGCTGATATGGACTTTAGTGCCCTGCTGTCACAGATTTCCTCTAGTGGGCAGG
GAGGAGGTGGAAGCGGCTTCAGCGTGGACACCAGTGCCCTGCTGGACCTGTTCAGCCCCTCGGT
GACCGTGCCCGACATGAGCCTGCCTGACCTTGACAGCAGCCTGGCCAGTATCCAAGAGCTCCTG
TCTCCCCAGGAGCCCCCCAGGCCTCCCGAGGCAGAGAACAGCAGCCCGGATTCAGGGAAGCAGC
TGGTGCACTACACAGCGCAGCCGCTGTTCCTGCTGGACCCCGGCTCCGTGGACACCGGGAGCAA
CGACCTGCCGGTGCTGTTTGAGCTGGGAGAGGGCTCCTACTTCTCCGAAGGGGACGGCTTCGCC
GAGGACCCCACCATCTCCCTGCTGACAGGCTCGGAGCCTCCCAAAGCCAAGGACCCCACTGTCT
CCTGTACAGGCAGTGGAGAGGGCAGAGGAAGTCTGCTAACATGCGGTGACGTCGAGGAGAATCC
TGGCCCAACCATGAAAAGCCTGAACTCACCGCTACCTCTGTCGAGAAGTTTCTGATCGAAAAG
TTCGACAGCGTCTCCGACCTGATGCAGCTCTCCGAGGGCGAAGAATCTCGGGCTTTCAGCTTCG
ATGTGGGAGGGCGTGGATATGTCCTGCGGGTGAATAGCTGCGCCGATGGTTTCTACAAAGATCG
CTATGTTTATCGGCACTTTGCATCCGCCGCTCTCCCTATTCCCGAAGTGCTTGACATTGGGGAG
TTCAGCGAGAGCCTGACCTATTGCATCTCCCGCCGTGCACAGGGTGTCACCTTGCAAGACCTGC
CTGAAACCGAACTGCCCGCTGTTCTCCAGCCCGTCGCCGAGGCCATGGATGCCATCGCTGCCGC
CGATCTTAGCCAGACCAGCGGGTTCGGCCCATTCGGACCTCAAGGAATCGGTCAATACACTACA
TGGCGCGATTTCATCTGCGCTATTGCTGATCCCCATGTGTATCACTGGCAAACTGTGATGGACG
```

FIG. 80W

ACACCGTCAGTGCCTCCGTCGCCCAGGCTCTCGATGAGCTGATGCTTTGGGCCGAGGACTGCCC
CGAAGTCCGGCACCTCGTGCACGCCGATTTCGGCTCCAACAATGTCCTGACCGACAATGGCCGC
ATAACAGCCGTCATTGACTGGAGCGAGGCCATGTTCGGGGATTCCCAATACGAGGTCGCCAACA
TCTTCTTCTGGAGGCCCTGGTTGGCTTGTATGGAGCAGCAGACCCGCTACTTCGAGCGGAGGCA
TCCCGAGCTTGCAGGATCTCCTCGGCTCCGGGCTTATATGCTCCGCATTGGTCTTGACCAACTC
TATCAGAGCTTGGTTGACGGCAATTTCGATGATGCAGCTTGGGCTCAGGGTCGCTGCGACGCAA
TCGTCCGGTCCGGAGCCGGGACTGTCGGGCGTACACAAATCGCCCGCAGAAGCGCTGCCGTCTG
GACCGATGGCTGTGTGGAAGTGCTCGCCGATAGTGGAAACAGACGCCCCAGCACTCGTCCTAGG
GCAAAGGATCTGCAGTAATGA

4.2.1 EF1α

TGCAAAGATGGATAAAGTTTTAAACAGAGAGGAATCTTTGCAGCTAATGGACCTTCTAGGTCTT
GAAGGAGTGGGAATTGGCTCCGGTGCCCGTCAGTGGGCAGAGCGCACATCGCCCACAGTCCCC
GAGAAGTTGGGGGGAGGGGTCGGCAATTGAACCGGTGCCTAGAGAAGGTGGCGCGGGGTAAACT
GGGAAAGTGATGTCGTGTACTGGCTCCGCCTTTTCCCGAGGGTGGGGGAGAACCGTATATAAG
TGCAGTAGTCGCCGTGAACGTTCTTTTTCGCAACGGGTTTGCCGCCAGAACACAGGTAAGTGCC
GTGTGTGGTTCCCGCGGGCCTGGCCTCTTTACGGGTTATGGCCCTTGCGTGCCTTGAATTACTT
CCACCTGGCTGCAGTACGTGATTCTTGATCCCGAGCTTCGGGTTGGAAGTGGGTGGGAGAGTTC
GAGGCCTTGCGCTTAAGGAGCCCCTTCGCCTCGTGCTTGAGTTGAGGCCTGGCCTGGGCGCTGG
GGCCGCCGCGTGCGAATCTGGTGGCACCTTCGCGCCTGTCTCGCTGCTTTCGATAAGTCTCTAG
CCATTTAAAATTTTGATGACCTGCTGCGACGCTTTTTTCTGGCAAGATAGTCTTGTAAATGC
GGGCCAAGATCTGCACACTGGTATTTCGGTTTTGGGGCCGCGGGCGGCGACGGGCCCGTGCG
TCCCAGCGCACATGTTCGGCGAGGCGGGGCCTGCGAGCGCGGCCACCGAGAATCGGACGGGGGT
AGTCTCAAGCTGGCCGGCCTGCTCTGGTGCCTGGCCTCGCGCCGCCGTGTATCGCCCCGCCCTG
GGCGGCAAGGCTGGCCCGGTCGGCACCAGTTGCGTGAGCGGAAAGATGGCCGCTTCCCGGCCCT
GCTGCAGGGAGCTCAAAATGGAGGACGCGGCGCTCGGGAGAGCGGGCGGGTGAGTCACCCACAC
AAAGGAAAAGGGCCTTTCCGTCCTCAGCCGTCGCTTCATGTGACTCCACGGAGTACCGGGCGCC
GTCCAGGCACCTCGATTAGTTCTCGAGCTTTTGGAGTACGTCGTCTTTAGGTTGGGGGGAGGGG
TTTTATGCGATGGAGTTTCCCCACACTGAGTGGGTGGAGACTGAAGTTAGGCCAGCTTGGCACT
TGATGTAATTCTCCTTGGAATTTGCCCTTTTTGAGTTTGGATCTTGGTTCATTCTCAAGCCTCA
GACAGTGGTTCAAAGTTTTTTTCTTCCATTTCAGGTGTCGTGA

ATGGCTTCAAACTTTACTCAGTTCGTGCTCGTGGACAATGGTGGGACAGGGGATGTGACAGTGG
CTCCTTCTAATTTCGCTAATGGGGTGGCAGAGTGGATCAGCTCCAACTCACGGAGCCAGGCCTA
CAAGGTGACATGCAGCGTCAGGCAGTCTAGTGCCCAGAAGAGAAAGTATACCATCAAGGTGGAG
GTCCCCAAAGTGGCTACCCAGACAGTGGGCGGAGTCGAACTGCCTGTCGCCGCTTGGAGGTCCT
ACCTGAACATGGAGCTCACTATCCCAATTTTCGCTACCAATTCTGACTGTGAACTCATCGTGAA
GGCAATGCAGGGGCTCCTCAAAGACGGTAATCCTATCCCTTCCGCCATCGCCGCTAACTCAGGT
ATCTAC

4.2.3 NLS

GGACCTAAGAAAAAGAGGAAGGTGGCGGCCGCT

4.2.4 p65

CCTTCAGGGCAGATCAGCAACCAGGCCCTGGCTCTGGCCCCTAGCTCCGCTCCAGTGCTGGCCC
AGACTATGGTGCCCTCTAGTGCTATGGTGCCTCTGGCCCAGCCACCTGCTCCAGCCCCTGTGCT
GACCCCAGGACCACCCCAGTCACTGAGCGCTCCAGTGCCCAAGTCTACACAGGCCGGCGAGGGG
ACTCTGAGTGAAGCTCTGCTGCACCTGCAGTTCGACGCTGATGAGGACCTGGGAGCTCTGCTGG
GGAACAGCACCGATCCCGGAGTGTTCACAGATCTGGCCTCCGTGGACAACTCTGAGTTTCAGCA
GCTGCTGAATCAGGGCGTGTCCATGTCTCATAGTACAGCCGAACCAATGCTGATGGAGTACCCC
GAAGCCATTACCCGGCTGGTGACCGGCAGCCAGCGGCCCCCCGACCCCGCTCCAACTCCCCTGG
GAACCAGCGGCCTGCCTAATGGGCTGTCCGGAGATGAAGACTTCTCAAGCATCGCTGATATGGA
CTTTAGTGCCCTGCTGTCACAGATTTCCTCTAGTGGGCAG

4.2.5 HSF1

GGCTTCAGCGTGGACACCAGTGCCCTGCTGGACCTGTTCAGCCCCTCGGTGACCGTGCCCGACA
TGAGCCTGCCTGACCTTGACAGCAGCCTGGCCAGTATCCAAGAGCTCCTGTCTCCCCAGGAGCC
CCCCAGGCCTCCCGAGGCAGAGAACAGCAGCCCGGATTCAGGGAAGCAGCTGGTGCACTACACA
GCGCAGCCGCTGTTCCTGCTGGACCCCGGCTCCGTGGACACCGGGAGCAACGACCTGCCGGTGC
TGTTTGAGCTGGGAGAGGGCTCCTACTTCTCCGAAGGGGACGGCTTCGCCGAGGACCCCACCAT
CTCCCTGCTGACAGGCTCGGAGCCTCCCAAAGCCAAGGACCCCACTGTCTCC

GGCAGTGGAGAGGGCAGAGGAAGTCTGCTAACATGCGGTGACGTCGAGGAGAATCCTGGCCCA

4.2.7 Hygro

ACCATGAAAAAGCCTGAACTCACCGCTACCTCTGTCGAGAAGTTTCTGATCGAAAAGTTCGACA
GCGTCTCCGACCTGATGCAGCTCTCCGAGGGCGAAGAATCTCGGGCTTTCAGCTTCGATGTGGG
AGGGCGTGGATATGTCCTGCGGGTGAATAGCTGCGCCGATGGTTTCTACAAAGATCGCTATGTT
TATCGGCACTTTGCATCCGCCGCTCTCCCTATTCCCGAAGTGCTTGACATTGGGGAGTTCAGCG
AGAGCCTGACCTATTGCATCTCCCGCCGTGCACAGGGTGTCACCTTGCAAGACCTGCCTGAAAC
CGAACTGCCCGCTGTTCTCCAGCCCGTCGCCGAGGCCATGGATGCCATCGCTGCCGCCGATCTT
AGCCAGACCAGCGGGTTCGGCCCATTCGGACCTCAAGGAATCGGTCAATACACTACATGGCGCG
ATTTCATCTGCGCTATTGCTGATCCCCATGTGTATCACTGGCAAACTGTGATGGACGACACCGT
CAGTGCCTCCGTCGCCCAGGCTCTCGATGAGCTGATGCTTTGGGCCGAGGACTGCCCCGAAGTC
CGGCACCTCGTGCACGCCGATTTCGGCTCCAACAATGTCCTGACCGACAATGGCCGCATAACAG
CCGTCATTGACTGGAGCGAGGCCATGTTCGGGGATTCCCAATACGAGGTCGCCAACATCTTCTT
CTGGAGGCCCTGGTTGGCTTGTATGGAGCAGCAGACCGCTACTTCGAGCGGAGGCATCCCGAG
CTTGCAGGATCTCCTCGGCTCCGGGCTTATATGCTCCGCATTGGTCTTGACCAACTCTATCAGA
GCTTGGTTGACGGCAATTTCGATGATGCAGCTTGGGCTCAGGGTCGCTGCGACGCAATCGTCCG
GTCCGGAGCCGGGACTGTCGGGCGTACACAAATCGCCCGCAGAAGCGCTGCCGTCTGGACCGAT
GGCTGTGTGGAAGTGCTCGCCGATAGTGGAAACAGACGCCCCAGCACTCGTCCTAGGGCAAAGG
ATCTGCAGTAATGA

4.3  pFUGW-U6-sgRNA-EF1α-Zeo

GAGGGCCTATTTCCCATGATTCCTTCATATTTGCATATACGATACAAGGCTGTTAGAGAGATAA
TTGGAATTAATTTGACTGTAAACACAAAGATATTAGTACAAAATACGTGACGTAGAAAGTAATA
ATTTCTTGGGTAGTTTGCAGTTTTAAAATTATGTTTTAAAATGGACTATCATATGCTTACCGTA
ACTTGAAAGTATTTCGATTTCTTGGCTTTATATATCTTGTGGAAAGGACGAAACACCGGAGACG
GGATACCGTCTCTGTTTTAGAGCTAGGCCAACATGAGGATCACCCATGTCTGCAGGGCCTAGCA
AGTTAAAATAAGGCTAGTCCGTTATCAACTTGGCCAACATGAGGATCACCCATGTCTGCAGGGC
CAAGTGGCACCGAGTCGGTGCTTTTTTGGATCCTGCAAAGATGGATAAAGTTTTAAACAGAGA
GGAATCTTTGCAGCTAATGGACCTTCTAGGTCTTGAAAGGAGTGGGAATTGGCTCCGGTGCCCG
TCAGTGGGCAGAGCGCACATCGCCCACAGTCCCCGAGAAGTTGGGGGGAGGGGTCGGCAATTGA
TCCGGTGCCTAGAGAAGGTGGCGCGGGGTAAACTGGGAAAGTGATGTCGTGTACTGGCTCCGCC
TTTTTCCCGAGGGTGGGGGAGAACCGTATATAAGTGCAGTAGTCGCCGTGAACGTTCTTTTTCG
```

FIG. 80Z

```
CAACGGGTTTGCCGCCAGAACACAGGTAAGTGCCGTGTGTGGTTCCCGCGGGCCTGGCCTCTTT
ACGGGTTATGGCCCTTGCGTGCCTTGAATTACTTCCACTGGCTGCAGTACGTGATTCTTGATCC
CGAGCTTCGGGTTGGAAGTGGGTGGGAGAGTTCGAGGCCTTGCGCTTAAGGAGCCCCTTCGCCT
CGTGCTTGAGTTGAGGCCTGGCCTGGGCGCTGGGGCCGCCGCGTGCGAATCTGGTGGCACCTTC
GCGCCTGTCTCGCTGCTTTCGATAAGTCTCTAGCCATTTAAAATTTTTGATGACCTGCTGCGAC
GCTTTTTTTCTGGCAAGATAGTCTTGTAAATGCGGGCCAAGATCTGCACACTGGTATTTCGGTT
TTTGGGCCGCGGGCGGCGACGGGGCCCGTGCGTCCCAGCGCACATGTTCGGCGAGGCGGGGCC
TGCGAGCGCGGCCACCGAGAATCGGACGGGGTAGTCTCAAGCTGGCCGGCCTGCTCTGGTGCC
TGGCCTCGCGCCGCCGTGTATCGCCCCGCCCTGGGCGGCAAGGCTGGCCCGGTCGGCACCAGTT
GCGTGAGCGGAAAGATGGCCGCTTCCCGGCCCTGCTGCAGGGAGCTCAAAATGGAGGACGCGGC
GCTCGGGAGAGCGGGCGGGTGAGTCACCCACACAAAGGAAAAGGGCCTTTCCGTCCTCAGCCGT
CGCTTCATGTGACTCCACGGAGTACCGGGCGCCGTCCAGGCACCTCGATTAGTTCTCGAGCTTT
TGGAGTACGTCGTCTTTAGGTTGGGGGAGGGGTTTTATGCGATGGAGTTTCCCCACACTGAGT
GGGTGGAGACTGAAGTTAGGCCAGCTTGGCACTTGATGTAATTCTCCTTGGAATTTGCCCTTTT
TGAGTTTGGATCTTGGTTCATTCTCAAGCCTCAGACAGTGGTTCAAAGTTTTTTCTTCCATTT
CAGGTGTCGTGATGTACAATGGCCAAGTTGACCAGTGCCGTTCCGGTGCTCACCGCGCGCGACG
TCGCCGGAGCGGTCGAGTTCTGGACCGACCGGCTCGGGTTCTCCCGGGACTTCGTGGAGGACGA
CTTCGCCGGTGTGGTCCGGGACGACGTGACCCTGTTCATCAGCGCGGTCCAGGACCAGGTGGTG
CCGGACAACACCCTGGCCTGGGTGTGGGTGCGCGGCCTGGACGAGCTGTACGCCGAGTGGTCGG
AGGTCGTGTCCACGAACTTCCGGGACGCCTCCGGGCCGGCCATGACCGAGATCGGCGAGCAGCC
GTGGGGGCGGGAGTTCGCCCTGCGCGACCCGGCCGGCAACTGCGTGCACTTCGTGGCCGAGGAG
CAGGACTGA 4.3.1 U6

GAGGGCCTATTTCCCATGATTCCTTCATATTTGCATATACGATACAAGGCTGTTAGAGAGATAA
TTGGAATTAATTTGACTGTAAACACAAAGATATTAGTACAAAATACGTGACGTAGAAAGTAATA
ATTTCTTGGGTAGTTTGCAGTTTTAAAATTATGTTTTAAAATGGACTATCATATGCTTACCGTA
ACTTGAAAGTATTTCGATTTCTTGGCTTTATATATCTTGTGGAAAGGACGAAACACC 4.3.2 sgRNA

GTTTTAGAGCTAGGCCAACATGAGGATCACCCATGTCTGCAGGGCCTAGCAAGTTAAAATAAGG
CTAGTCCGTTATCAACTTGGCCAACATGAGGATCACCCATGTCTGCAGGGCCAAGTGGCACCGA
GTCGGTGC
```

```
TGCAAAGATGGATAAAGTTTTAAACAGAGAGGAATCTTTGCAGCTAATGGACCTTCTAGGTCTT
GAAAGGAGTGGGAATTGGCTCCGGTGCCCGTCAGTGGGCAGAGCGCACATCGCCCACAGTCCCC
GAGAAGTTGGGGGGAGGGGTCGGCAATTGATCCGGTGCCTAGAGAAGGTGGCGCGGGGTAAACT
GGGAAAGTGATGTCGTGTACTGGCTCCGCCTTTTTCCCGAGGGTGGGGGAGAACCGTATATAAG
TGCAGTAGTCGCCGTGAACGTTCTTTTTCGCAACGGGTTTGCCGCCAGAACACAGGTAAGTGCC
GTGTGTGGTTCCCGCGGGCCTGGCCTCTTTACGGGTTATGGCCCTTGCGTGCCTTGAATTACTT
CCACTGGCTGCAGTACGTGATTCTTGATCCCGAGCTTCGGGTTGGAAGTGGGTGGGAGAGTTCG
AGGCCTTGCGCTTAAGGAGCCCCTTCGCCTCGTGCTTGAGTTGAGGCCTGGCCTGGGCGCTGGG
GCCGCCGCGTGCGAATCTGGTGGCACCTTCGCGCCTGTCTCGCTGCTTTCGATAAGTCTCTAGC
CATTTAAAATTTTTGATGACCTGCTGCGACGCTTTTTTTCTGGCAAGATAGTCTTGTAAATGCG
GGCCAAGATCTGCACACTGGTATTTCGGTTTTTGGGGCCGCGGGCGGCGACGGGGCCCGTGCGT
CCCAGCGCACATGTTCGGCGAGGCGGGGCCTGCGAGCGCGGCCACCGAGAATCGGACGGGGGTA
GTCTCAAGCTGGCCGGCCTGCTCTGGTGCCTGGCCTCGCGCCGCCGTGTATCGCCCCGCCCTGG
GCGGCAAGGCTGGCCCGGTCGGCACCAGTTGCGTGAGCGGAAAGATGGCCGCTTCCCGGCCCTG
CTGCAGGGAGCTCAAAATGGAGGACGCGGCGCTCGGGAGAGCGGGCGGGTGAGTCACCCACACA
AAGGAAAGGGCCTTTCCGTCCTCAGCCGTCGCTTCATGTGACTCCACGGAGTACCGGGCGCCG
TCCAGGCACCTCGATTAGTTCTCGAGCTTTTGGAGTACGTCGTCTTTAGGTTGGGGGGAGGGGT
TTTATGCGATGGAGTTTCCCCACACTGAGTGGGTGGAGACTGAAGTTAGGCCAGCTTGGCACTT
GATGTAATTCTCCTTGGAATTTGCCCTTTTTGAGTTTGGATCTTGGTTCATTCTCAAGCCTCAG
ACAGTGGTTCAAAGTTTTTTCTTCCATTTCAGGTGTCGTGA
```

4.3.4 Zeo

```
ATGGCCAAGTTGACCAGTGCCGTTCCGGTGCTCACCGCGCGCGACGTCGCCGGAGCGGTCGAGT
TCTGGACCGACCGGCTCGGGTTCTCCCGGGACTTCGTGGAGGACGACTTCGCCGGTGTGGTCCG
GGACGACGTGACCCTGTTCATCAGCGCGGTCCAGGACCAGGTGGTGCCGGACAACACCCTGGCC
TGGGTGTGGGTGCGCGGCCTGGACGAGCTGTACGCCGAGTGGTCGGAGGTCGTGTCCACGAACT
TCCGGGACGCCTCCGGGCCGGCCATGACCGAGATCGGCGAGCAGCCGTGGGGGCGGGAGTTCGC
CCTGCGCGACCCGGCCGGCAACTGCGTGCACTTCGTGGCCGAGGAGCAGGACTGA
```

4.4 pFUGW-U6-sgRNA-EF1α-Puro

```
GAGGGCCTATTTCCCATGATTCCTTCATATTTGCATATACGATACAAGGCTGTTAGAGAGATAA
TTGGAATTAATTTGACTGTAAACACAAAGATATTAGTACAAAATACGTGACGTAGAAAGTAATA
ATTTCTTGGGTAGTTTGCAGTTTTAAAATTATGTTTTAAAATGGACTATCATATGCTTACCGTA
```

FIG. 80BB

```
ACTTGAAAGTATTTCGATTTCTTGGCTTTATATATCTTGTGGAAAGGACGAAACACCGGAGACG
GGATACCGTCTCTGTTTTAGAGCTAGGCCAACATGAGGATCACCCATGTCTGCAGGGCCTAGCA
AGTTAAAATAAGGCTAGTCCGTTATCAACTTGGCCAACATGAGGATCACCCATGTCTGCAGGGC
CAAGTGGCACCGAGTCGGTGCTTTTTTGGATCCTGCAAAGATGGATAAAGTTTTAAACAGAGA
GGAATCTTTGCAGCTAATGGACCTTCTAGGTCTTGAAAGGAGTGGGAATTGGCTCCGGTGCCCG
TCAGTGGGCAGAGCGCACATCGCCCACAGTCCCCGAGAAGTTGGGGGGAGGGTCGGCAATTGA
TCCGGTGCCTAGAGAAGGTGGCGCGGGGTAAACTGGGAAAGTGATGTCGTGTACTGGCTCCGCC
TTTTTCCCGAGGGTGGGGGAGAACCGTATATAAGTGCAGTAGTCGCCGTGAACGTTCTTTTTCG
CAACGGGTTTGCCGCCAGAACACAGGTAAGTGCCGTGTGTGGTTCCCGCGGGCCTGGCCTCTTT
ACGGGTTATGGCCCTTGCGTGCCTTGAATTACTTCCACCGGCTGCAGTACGTGATTCTTGATCC
CGAGCTTCGGGTTGGAAGTGGGTGGGAGAGTTCGAGGCCTTGCGCTTAAGGAGCCCCTTCGCCT
CGTGCTTGAGTTGAGGCCTGGCCTGGGCGCTGGGGCCGCCGCGTGCGAATCTGGTGGCACCTTC
GCGCCTGTCTCGCTGCTTTCGATAAGTCTCTAGCCATTTAAAATTTTGATGACCTGCTGCGAC
GCTTTTTTTCTGGCAAGATAGTCTTGTAAATGCGGGCCAAGATCTGCACACTGGTATTTCGGTT
TTTGGGGCCGCGGGCGGCGACGGGGCCCGTGCGTCCCAGCGCACATGTTCGGCGAGGCGGGGCC
TGCGAGCGCGGCCACCGAGAATCGGACGGGGGTAGTCTCAAGCTGGCCGGCCTGCTCTGGTGCC
TGGCCTCGCGCCGCCGTGTATCGCCCCGCCCTGGGCGGCAAGGCTGGCCCGGTCGGCACCAGTT
GCGTGAGCGGAAAGATGGCCGCTTCCCGGCCCTGCTGCAGGGAGCTCAAAATGGAGGACGCGGC
GCTCGGGAGAGCGGGCGGGTGAGTCACCCACACAAAGGAAAAGGGCCTTTCCGTCCTCAGCCGT
CGCTTCATGTGACTCCACGGAGTACCGGGCGCCGTCCAGGCACCTCGATTAGTTCTCGAGCTTT
TGGAGTACGTCGTCTTTAGGTTGGGGGAGGGGTTTTATGCGATGGAGTTTCCCCACACTGAGT
GGGTGGAGACTGAAGTTAGGCCAGCTTGGCACTTGATGTAATTCTCCTTGGAATTTGCCCTTTT
TGAGTTTGGATCTTGGTTCATTCTCAAGCCTCAGACAGTGGTTCAAAGTTTTTTCTTCCATTT
CAGGTGTCGTGATGTACAATGACCGAGTACAAGCCCACGGTGCGCCTCGCCACCCGCGACGACG
TCCCCAGGGCCGTACGCACCCTCGCCGCCGCGTTCGCCGACTACCCCGCCACGCGCCACACCGT
CGATCCGGACCGCCACATCGAGCGGGTCACCGAGCTGCAAGAACTCTTCCTCACGCGCGTCGGG
CTCGACATCGGCAAGGTGTGGGTCGCGGACGACGGCGCCGCCGTGGCGGTCTGGACCACGCCGG
AGAGCGTCGAAGCGGGGGCGGTGTTCGCCGAGATCGGCCCGCGCATGGCCGAGTTGAGCGGTTC
CCGGCTGGCCGCGCAGCAACAGATGGAAGGCCTCCTGGCGCCGCACCGGCCCAAGGAGCCCGCG
TGGTTCCTGGCCACCGTCGGAGTCTCGCCCGACCACCAGGGCAAGGGTCTGGGCAGCGCCGTCG
TGCTCCCCGGAGTGGAGGCGGCCGAGCGCGCCGGGGTGCCCGCCTTCCTGGAGACCTCCGCGCC
CCGCAACCTCCCCTTCTACGAGCGGCTCGGCTTCACCGTCACCGCCGACGTCGAGGTGCCCGAA
GGACCGCGCACCTGGTGCATGACCCGCAAGCCCGGTGCCTGA
```

GAGGGCCTATTTCCCATGATTCCTTCATATTTGCATATACGATACAAGGCTGTTAGAGAGATAA
TTGGAATTAATTTGACTGTAAACACAAAGATATTAGTACAAAATACGTGACGTAGAAAGTAATA
ATTTCTTGGGTAGTTTGCAGTTTTAAAATTATGTTTTAAAATGGACTATCATATGCTTACCGTA
ACTTGAAAGTATTTCGATTTCTTGGCTTTATATATCTTGTGGAAAGGACGAAACACC

4.4.2 sgRNA

GTTTTAGAGCTAGGCCAACATGAGGATCACCCATGTCTGCAGGGCCTAGCAAGTTAAAATAAGG
CTAGTCCGTTATCAACTTGGCCAACATGAGGATCACCCATGTCTGCAGGGCCAAGTGGCACCGA
GTCGGTGC

4.4.3 EF1α

TGCAAAGATGGATAAAGTTTTAAACAGAGAGGAATCTTTGCAGCTAATGGACCTTCTAGGTCTT
GAAGGAGTGGGAATTGGCTCCGGTGCCCGTCAGTGGGCAGAGCGCACATCGCCCACAGTCCCC
GAGAAGTTGGGGGGAGGGGTCGGCAATTGATCCGGTGCCTAGAGAAGGTGGCGCGGGGTAAACT
GGGAAAGTGATGTCGTGTACTGGCTCCGCCTTTTTCCCGAGGGTGGGGGAGAACCGTATATAAG
TGCAGTAGTCGCCGTGAACGTTCTTTTTCGCAACGGGTTTGCCGCCAGAACACAGGTAAGTGCC
GTGTGTGGTTCCCGCGGGCCTGGCCTCTTTACGGGTTATGGCCCTTGCGTGCCTTGAATTACTT
CCACCGGCTGCAGTACGTGATTCTTGATCCCGAGCTTCGGGTTGGAAGTGGGTGGGAGAGTTCG
AGGCCTTGCGCTTAAGGAGCCCCTTCGCCTCGTGCTTGAGTTGAGGCCTGGCCTGGGCGCTGGG
CCGCCGCGTGCGAATCTGGTGGCACCTTCGCGCCTGTCTCGCTGCTTTCGATAAGTCTCTAGC
CATTTAAAATTTTTGATGACCTGCTGCGACGCTTTTTTTCTGGCAAGATAGTCTTGTAAATGCG
GGCCAAGATCTGCACACTGGTATTTCGGTTTTTGGGGCCGCGGGCGGCGACGGGGCCCGTGCGT
CCCAGCGCACATGTTCGGCGAGGCGGGGCCTGCGAGCGCGGCCACCGAGAATCGGACGGGGGTA
GTCTCAAGCTGGCCGGCCTGCTCTGGTGCCTGGCCTCGCGCCGCCGTGTATCGCCCCGCCTGG
GCGGCAAGGCTGGCCCGGTCGGCACCAGTTGCGTGAGCGGAAAGATGGCCGCTTCCCGGCCCTG
CTGCAGGGAGCTCAAAATGGAGGACGCGGCGCTCGGGAGAGCGGGCGGGTGAGTCACCCACACA
AAGGAAAAGGGCCTTTCCGTCCTCAGCCGTCGCTTCATGTGACTCCACGGAGTACCGGGCGCCG
TCCAGGCACCTCGATTAGTTCTCGAGCTTTTGGAGTACGTCGTCTTTAGGTTGGGGGGAGGGGT
TTTATGCGATGGAGTTTCCCCACACTGAGTGGGTGGAGACTGAAGTTAGGCCAGCTTGGCACTT
GATGTAATTCTCCTTGGAATTTGCCCTTTTTGAGTTTGGATCTTGGTTCATTCTCAAGCCTCAG
ACAGTGGTTCAAAGTTTTTTCTTCCATTTCAGGTGTCGTGA

FIG. 80DD

4.4.4 Puro

```
ATGACCGAGTACAAGCCCACGGTGCGCCTCGCCACCCGCGACGACGTCCCCAGGGCCGTACGCA
CCCTCGCCGCCGCGTTCGCCGACTACCCCGCCACGCGCCACACCGTCGATCCGGACCGCCACAT
CGAGCGGGTCACCGAGCTGCAAGAACTCTTCCTCACGCGCGTCGGGCTCGACATCGGCAAGGTG
TGGGTCGCGGACGACGGCGCCGCCGTGGCGGTCTGGACCACGCCGGAGAGCGTCGAAGCGGGGG
CGGTGTTCGCCGAGATCGGCCCGCGCATGGCCGAGTTGAGCGGTTCCCGGCTGGCCGCGCAGCA
ACAGATGGAAGGCCTCCTGGCGCCGCACCGGCCCAAGGAGCCCGCGTGGTTCCTGGCCACCGTC
GGAGTCTCGCCCGACCACCAGGGCAAGGGTCTGGGCAGCGCCGTCGTGCTCCCCGGAGTGGAGG
CGGCCGAGCGCGCCGGGGTGCCCGCCTTCCTGGAGACCTCCGCGCCCCGCAACCTCCCCTTCTA
CGAGCGGCTCGGCTTCACCGTCACCGCCGACGTCGAGGTGCCCGAAGGACCGCGCACCTGGTGC
ATGACCCGCAAGCCCGGTGCCTGA
```

FIG. 80EE

Target guide sequences used in this paper

| Gene | Target Sequence |
|---|---|
| Neurog2 | TGGTTCAGTGGCTGCGTGTC |
| ASCL1 | GCAGCCGCTCGCTGCAGCAG |
| MYOD1 | GGGCCCCTGCGGCCACCCCG |
| SOX2 | GCCGGCCGCGCGGGGGAGGC |
| SOX2 | CCATGTGACGGGGGCTGTCA |
| SOX2 | GGCAGGCGAGGAGGGGGAGG |
| SOX2 | GCTGCCGGGTTTTGCATGAA |
| SOX2 | GTATCCCCTCTCGCAGCAAC |
| SOX2 | AGGAGCCGCCGCGCGCTGAT |
| SOX2 | TTTACCCACTTCCTTCGAAA |
| SOX2 | GCAGGGTACTTAAATGAGGA |
| NANOG | CGCCAGGAGGGGTGGGTCTA |
| NANOG | GATTAACTGAGAATTCACAA |
| NANOG | TCTAGTTCCCCACCTAGTCT |
| NANOG | GCCTTGGTGAGACTGGTAGA |
| NANOG | TGTCTTCAGGTTCTGTTGCT |
| NANOG | TGATTTAAAAGTTGGAAACG |
| NANOG | CATATTCCTGATTTAAAAGT |
| NANOG | TCCCAATTTACTGGGATTAC |
| KLF4 | GCGCGCTCCACACAACTCAC |
| KLF4 | AAGGAACGCGCGCCGGCGGC |
| KLF4 | ATGGGAGAAGGCGGAGGAAA |
| KLF4 | GCAACGATGGAAGGGAGCCT |
| KLF4 | GCGCACGTGGGGGCGGGGA |
| KLF4 | GCCTGGCTGGCGTCACGGCC |
| KLF4 | GCCGCCGACACCACTGCCGC |
| KLF4 | CGGTTCCTCGCGCCCCGCGC |
| POU5F1 (OCT4) | GACACAACTGGCGCCCCTCC |
| POU5F1 (OCT4) | GGGGGGAGAAACTGAGGCGA |
| POU5F1 (OCT4) | TCTGTGGGGACCTGCACTG |
| POU5F1 (OCT4) | GGCACAGTGCCAGAGGTCTG |

FIG. 81A

| | |
|---|---|
| POU5F1 (OCT4) | GGTGAAATGAGGGCTTGCGA |
| POU5F1 (OCT4) | TCAAGGCTAGTGGGTGGGAC |
| POU5F1 (OCT4) | GGTGGTGGCAATGGTGTCTG |
| POU5F1 (OCT4) | ACAGGAATTCAAGACCAGCC |
| VEGFA | GCAAAGAGGGAACGGCTCTC |
| VEGFA | ACAGAGTTTCCGGGGGCGGA |
| VEGFA | CCCTTCATTGCGGCGGGCTG |
| VEGFA | GGCCCGAGCCGCGTGTGGAA |
| VEGFA | GCGGGCCGGGGGCGGGGTCC |
| VEGFA | TTTAAAGTCGGCTGGTAGC |
| HBG1 | TCCTGAACTTTTCAAAAAT |
| HBG1 | CACTGGAGCTAGAGACAAGA |
| HBG1 | GTATCCTCTATGATGGGAGA |
| HBG1 | AAAACTGGAATGACTGAAT |
| HBG1 | AAAATTAGCAGTATCCTCTT |
| HBG1 | ATGCAAATATCTGTCTGAAA |
| HBG1 | CTTGACCAATAGCCTTGACA |
| HBG1 | GGCTAGGGATGAAGAATAAA |
| TERT | GCCGCACGCACCTGTTCCCA |
| TERT | CTGCACCCTGGGAGCGCGAG |
| TERT | GCCCGGAGCAGCTGCGCTGT |
| TERT | CCAGGACCGCGCTTCCCACG |
| TERT | GAGCTGGAAGGTGAAGGGGC |
| TERT | CCCGACCCCTCCCGGGTCCC |
| TERT | GGAAGGAAGGGGAGGGGCT |
| TERT | GCGGCCCCGCCCTCTCCTCG |
| IL1B | TTAGTATATGTGGGACAAAG |
| IL1B | GAAATCCAGTATTTTAATG |
| IL1B | GAAAACAATGCATATTTGCA |
| IL1B | CTCTGGTTCATGGAAGGGCA |
| IL1B | AGTATTGGTGGAAGCTTCTT |
| IL1B | TTTAACTTGATTGTGAAATC |
| IL1B | TGGCTTTCAAAAGCAGAAGT |
| IL1B | AAAACAGCGAGGGAGAAAC |
| IL1R2 | AAACTCCACAATCTAGAATA |
| IL1R2 | TTAACAGTTAAAAATCATAC |

FIG. 81B

| | |
|---|---|
| IL1R2 | TGGAAAACCAACTCTTCCAC |
| IL1R2 | AGCATCTTTTCTCTTTAAT |
| IL1R2 | ATCACTTTAAAACCACCTCT |
| IL1R2 | AAACTTATGCGGCGTTTCCT |
| IL1R2 | GAGTACATGATCACCCAGAT |
| IL1R2 | GACCCAGCACTGCAGCCTGG |
| ZFP42 (REX1) | TAGCAATACAGTCACATTAA |
| ZFP42 (REX1) | GCCGGGCGTCTGGGCTCTGG |
| ZFP42 (REX1) | TGCCCGGCGGCCGGGCTGAG |
| ZFP42 (REX1) | GCCTGGGGGCCCCGGGCTGA |
| ZFP42 (REX1) | CCGGGCAGAGAGTGAACGCG |
| ZFP42 (REX1) | GCGGCGCCCCAGGGCGGGGC |
| ZFP42 (REX1) | ACCCTGGCGGAGCTGATGGG |
| ZFP42 (REX1) | GGGTCTTGGGAGGGGCGCA |
| MYC | GGCCCCACGGAAGCCTGAGC |
| MYC | CAGTGCGTTCTCGGTGTGGA |
| MYC | TTTGTCAAACAGTACTGCTA |
| MYC | GCGCGCGTAGTTAATTCATG |
| MYC | AGCTAGAGTGCTCGGCTGCC |
| MYC | GGTTCCCAAAGCAGAGGGCG |
| MYC | TCTCGCTAATCTCCGCCCAC |
| MYC | CCCTTTATAATGCGAGGGTC |
| LIN28A | AGAAGCAGGCCGCGCATTCC |
| LIN28A | GCGGGTCAGCTCCAAGCAGC |
| LIN28A | TCTGATTGGCCAGCGCCGCC |
| LIN28A | CCCATCTCCAGTTGTGCGTG |
| LIN28A | TCTGAGAAGGGACACCCCAG |
| LIN28A | CGGAGGGAAAGGGAGGGGAA |
| LIN28A | GGGGCTGCCCGCGGGGGGTT |
| LIN28A | GGGAGCCTTTGAAAAGCCGT |
| TINCR | TGGGCAGGCCCGGCCCGGCG |
| TINCR | GCGCACTCTGGGGCCAGCAG |
| TINCR | GGCTGGGATGACCTCGCTGA |
| TINCR | TGATCTTTTTAAGGACAGGC |
| TINCR | TCTCAAGTAGCTGGGACTAC |
| TINCR | CAGGTGCGGTGGCTCATGCC |

FIG. 81C

| | |
|---|---|
| TINCR | CTCACTGCAACCTCTGTCTG |
| HOTTIP | GGTGGGGCAGGGAAGGAAGG |
| HOTTIP | GCACCATTCACCCGGGGGAG |
| HOTTIP | TGCACCCGTCGTCCCCGCCG |
| HOTTIP | GTGGGCGGAGCGGGGGGGCC |
| HOTTIP | GCGCGCTCTTCACTTCTTGG |
| HOTTIP | TCGTAGAGAAACATGACGGT |
| HOTTIP | CGCGGCTGCGGCGGCGGCCG |
| HOTTIP | TTGGCGGCCTCTGCGCCCGC |
| PCAT-1 | TCGGAGCCACTCCCTCCTCT |
| PCAT-1 | AATTTGTCATAGTCTTGAGT |
| PCAT-1 | TCTTTTACATTGACTGATA |
| PCAT-1 | TGCTTTTGAATGAACACCCA |
| PCAT-1 | TTGGGTCTACTCACAATTT |
| PCAT-1 | GTTCTGTGAAGTCCAGTCCC |
| PCAT-1 | AGCAAGTACTCAATATATTT |
| PCAT-1 | AGTAGAGAGGCCAGGCACAG |
| LINC00925 | TAAAATAGAGCGGAGATATC |
| LINC00925 | CCTTCTTGAAGGTGCACTCA |
| LINC00925 | CAGGCTGTGGTTGTGACCTG |
| LINC00925 | TTTCTCCTGCGTCCTGGG |
| LINC00925 | CACGCTTCCAGCCACCCGCT |
| LINC00925 | CGATGCGCTTGCTGGGTCGC |
| LINC00925 | GGCTCCCAGCCCCAGCCCCC |
| LINC00925 | ACCAGCTGCCTTCTTCCCCC |
| LINC00514 | CAGCCCCTCCTTCTACCCTT |
| LINC00514 | GGGCAGGAGGTGGAGTGTCA |
| LINC00514 | GGGGGCCGGAGGGGGAGAGG |
| LINC00514 | GCAGGCTGAGAAGGGTGGGC |
| LINC00514 | TCTCATCAAGTGTCCACTCA |
| LINC00514 | GTCTCCCATCTCTCCTGCCC |
| LINC00514 | GGGTGTGGAAAGCCTGGTCT |
| LINC00514 | TGACTCTAGGCAGAGTGGGA |
| LINC00028 | TCGCGGCTGGAGGACGCTGC |
| LINC00028 | CGCCCCAGCCCCGGGGACG |
| LINC00028 | CAGGGACACGATGGTCCAAA |

FIG. 81D

| | |
|---|---|
| LINC00028 | GTCAGGAGTTTCCAGCCCGA |
| LINC00028 | CCCAGGAGGAGGCTGGGCCC |
| LINC00028 | GAGTGAGTTGGATTAAACTG |
| LINC00028 | CTGCTATACGCGAAGTTGCC |
| LINC00028 | ACGTTCTAGATTCACATGTC |
| Scrambled guide 1 | CTGAAAAGGAAGGAGTTGA |
| Scrambled guide 2 | AAGATGAAAGGAAAGGCGTT |

FIG. 81E

Top 300 depleted genes for A375. Mean depletion for each gene is given as the log2 ratio of Day 21 vs. Day 3 averaged over all sgRNAs for the gene.

| Gene | Mean_Depletion | Rank |
| --- | --- | --- |
| CDKN1A | -2.992660039 | 1 |
| MXI1 | -2.897744853 | 2 |
| STRBP | -2.829748727 | 3 |
| ZNF619 | -2.804758127 | 4 |
| SPANXF1 | -2.726815579 | 5 |
| FAM129B | -2.719695757 | 6 |
| CDKN1A | -2.656298721 | 7 |
| ARPP21 | -2.653166497 | 8 |
| NFATC1 | -2.629949555 | 9 |
| ADAMTS12 | -2.590207051 | 10 |
| SYNCRIP | -2.543127112 | 11 |
| DUSP9 | -2.525451884 | 12 |
| JUNB | -2.490663237 | 13 |
| YAF2 | -2.448742407 | 14 |
| SLC19A1 | -2.448391667 | 15 |
| MYBL1 | -2.447625101 | 16 |
| MEX3A | -2.409240548 | 17 |
| TRIB1 | -2.398434141 | 18 |
| CHST8 | -2.335622871 | 19 |
| ENOX2 | -2.304989857 | 20 |
| RNPEP | -2.279404126 | 21 |
| GRB10 | -2.278152274 | 22 |
| NKX2-1 | -2.277268968 | 23 |
| RTFDC1 | -2.276773205 | 24 |
| PRKAG2 | -2.257706064 | 25 |
| DUSP5 | -2.257470856 | 26 |
| CPEB4 | -2.257275333 | 27 |
| PRAME | -2.253782388 | 28 |
| ZNF583 | -2.236146291 | 29 |

FIG. 82A

| | | |
|---|---|---|
| NTRK2 | -2.187236566 | 30 |
| MEIS3 | -2.18329438 | 31 |
| CRY1 | -2.181419445 | 32 |
| GPR137B | -2.153058431 | 33 |
| TTLL12 | -2.14262453 | 34 |
| EEF1A1 | -2.136133061 | 35 |
| SPNS2 | -2.130267043 | 36 |
| BAG1 | -2.12875898 | 37 |
| PRDM1 | -2.126237386 | 38 |
| NAT8L | -2.11667318 | 39 |
| HSD17B8 | -2.106531573 | 40 |
| GALNT7 | -2.095244894 | 41 |
| WNT3A | -2.090472623 | 42 |
| TGFBR2 | -2.074145064 | 43 |
| RBM47 | -2.071991956 | 44 |
| LOXL4 | -2.061797982 | 45 |
| JADE3 | -2.038321308 | 46 |
| TMSB4Y | -2.026889341 | 47 |
| CHPF | -2.025890484 | 48 |
| MSRB3 | -2.02586623 | 49 |
| ZNF641 | -2.023295975 | 50 |
| DUX4L2 | -2.015241148 | 51 |
| BLOC1S2 | -2.002638012 | 52 |
| FAM49A | -2.001061567 | 53 |
| AUP1 | -1.997624613 | 54 |
| CDKN1C | -1.995664305 | 55 |
| SLC1A1 | -1.990961882 | 56 |
| ASB10 | -1.989066237 | 57 |
| WNK2 | -1.977746737 | 58 |
| ITGA5 | -1.954342921 | 59 |
| NFIC | -1.953212838 | 60 |
| KLK11 | -1.948539824 | 61 |
| WDR91 | -1.938490545 | 62 |
| S100A13 | -1.935432269 | 63 |
| PXDC1 | -1.927854467 | 64 |
| NDNF | -1.921200613 | 65 |

FIG. 82B

| | | |
|---|---|---|
| BRI3 | -1.911739793 | 66 |
| TMEM220 | -1.903966859 | 67 |
| DUSP14 | -1.898023448 | 68 |
| NAA35 | -1.885506504 | 69 |
| ZNF395 | -1.878461929 | 70 |
| MIA3 | -1.870671759 | 71 |
| KCNK10 | -1.867897168 | 72 |
| IGF2BP3 | -1.859186347 | 73 |
| ATP6V0A1 | -1.848977641 | 74 |
| POU3F3 | -1.848092491 | 75 |
| LMNA | -1.847152595 | 76 |
| LHFPL3 | -1.8465067 | 77 |
| ZNF665 | -1.84640875 | 78 |
| DYM | -1.837513747 | 79 |
| KLHL8 | -1.836730363 | 80 |
| WNT7A | -1.836730124 | 81 |
| SEC61A1 | -1.832537638 | 82 |
| TCF7L2 | -1.827830567 | 83 |
| GPRASP2 | -1.823465993 | 84 |
| CACNA1C | -1.821967953 | 85 |
| INO80 | -1.819581697 | 86 |
| MEX3C | -1.818591589 | 87 |
| ERG | -1.808903306 | 88 |
| ESPL1 | -1.801783358 | 89 |
| KLF2 | -1.798003457 | 90 |
| COL1A1 | -1.795687915 | 91 |
| RCC2 | -1.789402047 | 92 |
| PAK1 | -1.781478474 | 93 |
| GALNT13 | -1.779304272 | 94 |
| TMCC3 | -1.779143425 | 95 |
| WDR45B | -1.769033944 | 96 |
| RNF111 | -1.768775527 | 97 |
| BCL3 | -1.76223965 | 98 |
| FAM110B | -1.760460731 | 99 |
| LATS2 | -1.753053715 | 100 |
| GRTP1 | -1.749316218 | 101 |

FIG. 82C

| | | |
|---|---|---|
| 41891 | -1.740174795 | 102 |
| SPIRE2 | -1.737385676 | 103 |
| BIVM-ERCC5 | -1.73527893 | 104 |
| HOXC13 | -1.727592439 | 105 |
| SKI | -1.727146495 | 106 |
| HEXDC | -1.726799679 | 107 |
| BTG2 | -1.723525381 | 108 |
| EID2B | -1.719706185 | 109 |
| NELL2 | -1.718412006 | 110 |
| CELF1 | -1.710704793 | 111 |
| FXYD1 | -1.709774577 | 112 |
| GATA1 | -1.703530563 | 113 |
| AGPAT6 | -1.703304319 | 114 |
| PDGFRB | -1.702489783 | 115 |
| EFHB | -1.699297265 | 116 |
| OTX1 | -1.69840649 | 117 |
| CLIC1 | -1.698145729 | 118 |
| GNAO1 | -1.69117871 | 119 |
| TSPAN5 | -1.690531306 | 120 |
| GLB1 | -1.688687106 | 121 |
| PHF2 | -1.688502906 | 122 |
| MIIP | -1.687831215 | 123 |
| BFSP1 | -1.685843655 | 124 |
| PKDCC | -1.681959775 | 125 |
| UCN3 | -1.681603774 | 126 |
| AKAP11 | -1.681106799 | 127 |
| STK3 | -1.680125551 | 128 |
| DOT1L | -1.679505143 | 129 |
| CRHR1 | -1.678232195 | 130 |
| PLEKHO1 | -1.674893272 | 131 |
| ANKEF1 | -1.674522971 | 132 |
| EBF2 | -1.671684092 | 133 |
| COPE | -1.667505883 | 134 |
| USP28 | -1.666943424 | 135 |
| KMT2B | -1.664730943 | 136 |
| RIMS4 | -1.664556738 | 137 |

FIG. 82D

| | | |
|---|---|---|
| ADAMTS7 | -1.664444631 | 138 |
| FAM9A | -1.661881924 | 139 |
| EPHA2 | -1.65846104 | 140 |
| REEP6 | -1.657571504 | 141 |
| SIAH1 | -1.656570969 | 142 |
| FPR2 | -1.651081286 | 143 |
| AVL9 | -1.650350499 | 144 |
| SP3 | -1.649187872 | 145 |
| PCNXL3 | -1.646537811 | 146 |
| SHROOM4 | -1.645105253 | 147 |
| HNRNPAB | -1.642348412 | 148 |
| CACNA2D1 | -1.639847135 | 149 |
| FGFRL1 | -1.63856667 | 150 |
| SHB | -1.632097534 | 151 |
| CA2 | -1.631971681 | 152 |
| CAMK2N1 | -1.629137656 | 153 |
| ARHGAP4 | -1.62825701 | 154 |
| CPLX2 | -1.626599879 | 155 |
| HOXC11 | -1.626203388 | 156 |
| ITM2C | -1.625957387 | 157 |
| TRNT1 | -1.624893641 | 158 |
| DNAAF2 | -1.624882836 | 159 |
| GCC2 | -1.624354479 | 160 |
| TTC9 | -1.624140349 | 161 |
| IFT81 | -1.622920533 | 162 |
| PLEKHF1 | -1.62180107 | 163 |
| C10orf82 | -1.620405891 | 164 |
| KIAA0753 | -1.619239696 | 165 |
| WDR89 | -1.617607367 | 166 |
| CRCP | -1.611109935 | 167 |
| ADRA1A | -1.602361316 | 168 |
| TXLNG | -1.601904094 | 169 |
| ANKZF1 | -1.601604975 | 170 |
| EFHD2 | -1.599046924 | 171 |
| SERPINI1 | -1.598621083 | 172 |
| MIB1 | -1.597274936 | 173 |

FIG. 82E

| | | |
|---|---|---|
| MEAF6 | -1.593894564 | 174 |
| HLCS | -1.59025755 | 175 |
| ING2 | -1.589728576 | 176 |
| PYROXD2 | -1.589535269 | 177 |
| PPARGC1A | -1.587408566 | 178 |
| ANKRD30A | -1.586667965 | 179 |
| BTBD2 | -1.586118313 | 180 |
| IGSF8 | -1.580902664 | 181 |
| FAM69C | -1.577696726 | 182 |
| PAXIP1 | -1.576009399 | 183 |
| PAOX | -1.575951644 | 184 |
| ZNF667 | -1.572756871 | 185 |
| TCF3 | -1.56874959 | 186 |
| IMPA2 | -1.567559877 | 187 |
| UBE3D | -1.566869169 | 188 |
| SPATA31A1 | -1.566628243 | 189 |
| SLCO4A1 | -1.562067095 | 190 |
| PAPOLB | -1.561157727 | 191 |
| RHOBTB2 | -1.557854541 | 192 |
| WWC1 | -1.557454101 | 193 |
| MLXIP | -1.556308378 | 194 |
| MSH6 | -1.555493523 | 195 |
| TEX28 | -1.555077182 | 196 |
| TLR7 | -1.554718342 | 197 |
| TBC1D22A | -1.553299902 | 198 |
| COBL | -1.552319793 | 199 |
| ZBTB40 | -1.551377333 | 200 |
| EBAG9 | -1.551195482 | 201 |
| BHLHE23 | -1.549931838 | 202 |
| CCNE1 | -1.549380807 | 203 |
| FOSL2 | -1.548586206 | 204 |
| KANK1 | -1.545495013 | 205 |
| UBE2G1 | -1.545073693 | 206 |
| CTSZ | -1.544508991 | 207 |
| PIK3R1 | -1.541543206 | 208 |
| PLCD1 | -1.540526535 | 209 |

FIG. 82F

| | | |
|---|---|---|
| CFHR1 | -1.540322263 | 210 |
| EAPP | -1.539559841 | 211 |
| FOXN2 | -1.536894335 | 212 |
| NRXN3 | -1.536756987 | 213 |
| PRRG4 | -1.536411123 | 214 |
| AURKA | -1.535632929 | 215 |
| POLR2I | -1.535013569 | 216 |
| TEX38 | -1.534957213 | 217 |
| SNRPF | -1.534928953 | 218 |
| FZD6 | -1.534873785 | 219 |
| CHRDL2 | -1.53363039 | 220 |
| CAMK1D | -1.532738633 | 221 |
| TSPAN4 | -1.532033491 | 222 |
| ZNF514 | -1.53035277 | 223 |
| CTAG1A | -1.528262121 | 224 |
| TSPY1 | -1.518969471 | 225 |
| FAM45A | -1.515966792 | 226 |
| PHF23 | -1.514788961 | 227 |
| NRD1 | -1.514485943 | 228 |
| UBR5 | -1.514476856 | 229 |
| GTPBP10 | -1.51320279 | 230 |
| PLEKHM3 | -1.512593991 | 231 |
| TMEM181 | -1.512024763 | 232 |
| ANKRD44 | -1.510607784 | 233 |
| SULT4A1 | -1.510256216 | 234 |
| PDGFC | -1.509051383 | 235 |
| CDYL | -1.508799208 | 236 |
| CDC42EP2 | -1.508624776 | 237 |
| KCNMB3 | -1.507843102 | 238 |
| FOXI1 | -1.507819638 | 239 |
| FHL1 | -1.507785919 | 240 |
| JRK | -1.507056803 | 241 |
| FAM110C | -1.506457203 | 242 |
| NPEPPS | -1.506442168 | 243 |
| CNKSR3 | -1.505895119 | 244 |
| SYNGR1 | -1.50378579 | 245 |

FIG. 82G

| | | |
|---|---|---|
| LIG1 | -1.50220227 | 246 |
| UCK1 | -1.498574732 | 247 |
| PLEKHG3 | -1.498493459 | 248 |
| SHANK2 | -1.496266754 | 249 |
| SYNGR2 | -1.495929066 | 250 |
| FRMPD2 | -1.495810709 | 251 |
| SCAP | -1.494636312 | 252 |
| RGS22 | -1.493115397 | 253 |
| GALNT18 | -1.49152462 | 254 |
| GPAT2 | -1.491059745 | 255 |
| TRIM6-TRIM34 | -1.490703347 | 256 |
| AJUBA | -1.488388821 | 257 |
| GAS8 | -1.486564139 | 258 |
| PLXNA2 | -1.486492818 | 259 |
| RPN2 | -1.485389319 | 260 |
| RBMX | -1.485222602 | 261 |
| FOXF2 | -1.484610716 | 262 |
| ARHGAP31 | -1.483785576 | 263 |
| PNMA5 | -1.4816382 | 264 |
| SLAMF6 | -1.481389938 | 265 |
| HIST1H3J | -1.479761902 | 266 |
| HHAT | -1.479346095 | 267 |
| KCNC3 | -1.478985068 | 268 |
| PFKM | -1.477414591 | 269 |
| CDHR5 | -1.476532282 | 270 |
| GABRB3 | -1.476436096 | 271 |
| POLR1D | -1.476282564 | 272 |
| TTYH2 | -1.475655292 | 273 |
| TMEM198 | -1.475348451 | 274 |
| NRP2 | -1.474615777 | 275 |
| UBE3B | -1.474189706 | 276 |
| ZNF618 | -1.471872622 | 277 |
| PYGO1 | -1.471843021 | 278 |
| SLFN11 | -1.470539972 | 279 |
| LONRF3 | -1.470166863 | 280 |
| TSPAN17 | -1.468806125 | 281 |

FIG. 82H

| | | |
|---|---|---|
| STARD8 | -1.468402107 | 282 |
| HFE2 | -1.467933276 | 283 |
| LTBP1 | -1.466001082 | 284 |
| ENKD1 | -1.464456854 | 285 |
| PIGP | -1.462758078 | 286 |
| CHTF8 | -1.462614997 | 287 |
| EHD2 | -1.462454773 | 288 |
| ST6GAL1 | -1.460732993 | 289 |
| ZNF527 | -1.45924688 | 290 |
| SLC22A17 | -1.459181743 | 291 |
| C17orf62 | -1.458600852 | 292 |
| POLR2G | -1.457145699 | 293 |
| WDR88 | -1.455886365 | 294 |
| USP32 | -1.455612942 | 295 |
| CTNNA2 | -1.452748274 | 296 |
| LCOR | -1.452523453 | 297 |
| HDAC9 | -1.450768923 | 298 |
| WNT7B | -1.449752179 | 299 |
| LRRC4B | -1.449610591 | 300 |

FIG. 82I

Top 100 genes from the output of the RIGER algorithm for the sgRNA-Zeo PLX screen comparing PLX (mean of the two replicates at Day 21) to DMSO control (mean of the two replicates at Day 21). The Kolmogorov-Smirnov method was used to score genes.

| Gene | NES | Gene rank | p-value | p-value rank |
|---|---|---|---|---|
| EGFR | 1.9319 | 1 | 0.00000001 | 1 |
| LPAR5 | 1.9292 | 2 | 0.00000001 | 2 |
| GPR35 | 1.9277 | 3 | 0.0000001 | 3 |
| LPAR1 | 1.9262 | 4 | 0.00000045 | 4 |
| P2RY8 | 1.9248 | 5 | 0.00000045 | 5 |
| ARHGEF1 | 1.9184 | 6 | 0.0000009 | 6 |
| ITGB3 | 1.9116 | 7 | 0.0000031 | 7 |
| ITGA9 | 1.894 | 8 | 0.0000201 | 8 |
| ITGB5 | 1.89 | 9 | 0.000026 | 9 |
| CRB2 | 1.8895 | 10 | 0.00002695 | 10 |
| TYW1 | 1.8833 | 11 | 0.00003825 | 11 |
| VSX1 | 1.8752 | 12 | 0.00005925 | 12 |
| LOC102724862 | 1.8698 | 13 | 0.0000772 | 13 |
| BCAR3 | 1.8552 | 14 | 0.0001412 | 14 |
| PCDH7 | 1.8521 | 15 | 0.0001584 | 15 |
| KIAA0040 | 1.8506 | 16 | 0.0001687 | 16 |
| TFAP2C | 1.8468 | 17 | 0.0001934 | 17 |
| PHB | 1.6441 | 112 | 0.0002845 | 18 |
| IGF1R | 1.8125 | 18 | 0.0005271 | 19 |
| CGB8 | 1.8105 | 19 | 0.0005533 | 20 |
| RNF223 | 1.8075 | 20 | 0.0005983 | 21 |
| TFEB | 1.7961 | 21 | 0.0007757 | 22 |
| TOR3A | 1.7826 | 22 | 0.00103 | 23 |
| MRFAP1 | 1.7815 | 23 | 0.001049 | 24 |
| WNT7A | 1.7763 | 24 | 0.001158 | 25 |
| MEIS2 | 1.775 | 25 | 0.001189 | 26 |
| KCTD20 | 1.7703 | 26 | 0.001303 | 27 |
| SHB | 1.7691 | 27 | 0.001331 | 28 |

FIG. 83A

| | | | | |
|---|---|---|---|---|
| PLEKHG5 | 1.7665 | 28 | 0.001393 | 29 |
| DAG1 | 1.7612 | 29 | 0.00153 | 30 |
| RAPGEF1 | 1.7575 | 30 | 0.001632 | 31 |
| SSC5D | 1.7571 | 31 | 0.001645 | 32 |
| PSMF1 | 1.7564 | 32 | 0.001665 | 33 |
| ZNF747 | 1.7539 | 33 | 0.001736 | 34 |
| SIGIRR | 1.7537 | 34 | 0.001741 | 35 |
| ISLR2 | 1.7503 | 35 | 0.001843 | 36 |
| AARSD1 | 1.7439 | 36 | 0.002044 | 37 |
| SLC32A1 | 1.7418 | 37 | 0.002115 | 38 |
| PLXDC2 | 1.7393 | 38 | 0.002204 | 39 |
| FGF17 | 1.7376 | 39 | 0.002262 | 40 |
| SLC25A20 | 1.7366 | 40 | 0.002296 | 41 |
| DCAF7 | 1.7365 | 41 | 0.002299 | 42 |
| CA12 | 1.7364 | 42 | 0.002303 | 43 |
| MSRB3 | 1.7356 | 43 | 0.002335 | 44 |
| TRIM7 | 1.7353 | 44 | 0.002345 | 45 |
| RRAS2 | 1.7338 | 45 | 0.002397 | 46 |
| OSBPL1A | 1.7278 | 46 | 0.002622 | 47 |
| CEP63 | 1.7275 | 47 | 0.002638 | 48 |
| PHC2 | 1.7252 | 48 | 0.002725 | 49 |
| SPHK1 | 1.7246 | 49 | 0.00275 | 50 |
| ACP6 | 1.7206 | 50 | 0.002914 | 51 |
| NEIL3 | 1.7182 | 51 | 0.003017 | 52 |
| TNNC1 | 1.7141 | 52 | 0.003201 | 53 |
| KIAA1804 | 1.7133 | 53 | 0.003233 | 54 |
| MAP3K11 | 1.7131 | 54 | 0.003242 | 55 |
| ZNF582 | 1.7128 | 55 | 0.003256 | 56 |
| SNX13 | 1.7111 | 56 | 0.003333 | 57 |
| CPLX2 | 1.7104 | 57 | 0.003366 | 58 |
| FGD1 | 1.7102 | 58 | 0.003377 | 59 |
| DTX3 | 1.7093 | 59 | 0.003416 | 60 |
| IFNGR1 | 1.7078 | 60 | 0.003484 | 61 |
| LRRC10B | 1.7075 | 61 | 0.003499 | 62 |
| UBE2E3 | 1.7048 | 62 | 0.003629 | 63 |
| VKORC1 | 1.7028 | 63 | 0.003727 | 64 |

FIG. 83B

| | | | | |
|---|---|---|---|---|
| PPDPF | 1.6994 | 64 | 0.003893 | 65 |
| CCND2 | 1.697 | 65 | 0.004017 | 66 |
| TEAD4 | 1.6967 | 66 | 0.004032 | 67 |
| TMEM26 | 1.6961 | 67 | 0.004065 | 68 |
| HMGXB3 | 1.6959 | 68 | 0.004074 | 69 |
| PDCD4 | 1.6936 | 69 | 0.004192 | 70 |
| COA3 | 1.6924 | 70 | 0.004258 | 71 |
| LAMP5 | 1.6918 | 71 | 0.004287 | 72 |
| NEK5 | 1.6912 | 72 | 0.004322 | 73 |
| MRPS35 | 1.6901 | 73 | 0.004382 | 74 |
| TAPBP | 1.6892 | 74 | 0.004431 | 75 |
| FGF8 | 1.689 | 75 | 0.00444 | 76 |
| GBE1 | 1.6887 | 76 | 0.004455 | 77 |
| KCND1 | 1.6887 | 77 | 0.004458 | 78 |
| TRIB1 | 1.6883 | 78 | 0.004475 | 79 |
| SEBOX | 1.688 | 79 | 0.004493 | 80 |
| ATP10A | 1.6859 | 80 | 0.004614 | 81 |
| RNF41 | 1.6849 | 81 | 0.004673 | 82 |
| PROM1 | 1.6848 | 82 | 0.004676 | 83 |
| BCAP29 | 1.6819 | 83 | 0.004845 | 84 |
| EFNA1 | 1.6783 | 84 | 0.005063 | 85 |
| ZNF83 | 1.6778 | 85 | 0.005091 | 86 |
| MAGEB6 | 1.6774 | 86 | 0.005119 | 87 |
| TAS2R19 | 1.6766 | 87 | 0.005166 | 88 |
| BCAR1 | 1.6744 | 88 | 0.005307 | 89 |
| STAT4 | 1.6739 | 89 | 0.005336 | 90 |
| RPS16 | 1.6721 | 90 | 0.005454 | 91 |
| FICD | 1.6718 | 91 | 0.005475 | 92 |
| CPEB1 | 1.6713 | 92 | 0.005503 | 93 |
| TMEM133 | 1.6694 | 93 | 0.005625 | 94 |
| SNED1 | 1.6693 | 94 | 0.005635 | 95 |
| TCEA2 | 1.6684 | 95 | 0.005691 | 96 |
| GSR | 1.6667 | 96 | 0.005808 | 97 |
| IQGAP3 | 1.6618 | 97 | 0.006145 | 98 |
| RAB42 | 1.6617 | 98 | 0.006149 | 99 |
| ADORA1 | 1.6603 | 99 | 0.006254 | 100 |

FIG. 83C

Top 100 genes from the output of the RIGER algorithm for the sgRNA-Puro PLX screen comparing PLX (mean of the two replicates at Day 21) to DMSO control (mean of the two replicates at Day 21). The Kolmogorov-Smirnov method was used to score genes.

| Gene | NES | Gene rank | p-value | p-value rank |
|---|---|---|---|---|
| EGFR | 1.8164 | 3 | 0.00000001 | 1 |
| LPAR5 | 1.8175 | 1 | 0.00000001 | 2 |
| P2RY8 | 1.8165 | 2 | 0.00000001 | 3 |
| MECOM | 1.8111 | 4 | 0.0000003 | 4 |
| CRB2 | 1.8109 | 5 | 0.00000035 | 5 |
| GLIS3 | 1.7914 | 6 | 0.000014 | 6 |
| PCDH7 | 1.7879 | 7 | 0.00002015 | 7 |
| TFAP2C | 1.7749 | 8 | 0.00005425 | 8 |
| C9orf50 | 1.7679 | 9 | 0.00008335 | 9 |
| LPAR1 | 1.7678 | 10 | 0.000084 | 10 |
| CNR1 | 1.758 | 11 | 0.0001413 | 11 |
| BCAR3 | 1.7565 | 12 | 0.0001516 | 12 |
| ITGB3 | 1.7542 | 13 | 0.000169 | 13 |
| CGNL1 | 1.7529 | 14 | 0.0001793 | 14 |
| ZASP | 1.747 | 15 | 0.0002318 | 15 |
| P2RY1 | 1.7435 | 16 | 0.0002672 | 16 |
| TNRC18 | 1.7352 | 17 | 0.000363 | 17 |
| GPR35 | 1.7297 | 18 | 0.0004385 | 18 |
| ARHGEF2 | 1.7293 | 19 | 0.0004437 | 19 |
| KRAS | 1.7254 | 20 | 0.000504 | 20 |
| PBX2 | 1.7227 | 21 | 0.0005528 | 21 |
| PYGO1 | 1.719 | 22 | 0.0006131 | 22 |
| RASSF5 | 1.7167 | 23 | 0.0006551 | 23 |
| AKR1B1 | 1.7122 | 24 | 0.000745 | 24 |
| ZFHX4 | 1.7106 | 25 | 0.0007778 | 25 |
| ACVR2A | 1.7104 | 26 | 0.0007828 | 26 |
| ITGB5 | 1.7078 | 27 | 0.0008385 | 27 |
| LOC730183 | 1.7072 | 28 | 0.0008523 | 28 |

FIG. 84A

| | | | | |
|---|---|---|---|---|
| COL25A1 | 1.7057 | 29 | 0.0008865 | 29 |
| EPAS1 | 1.7044 | 30 | 0.0009167 | 30 |
| RPS16 | 1.7022 | 31 | 0.0009716 | 31 |
| CST5 | 1.7015 | 32 | 0.000991 | 32 |
| CHN2 | 1.6984 | 33 | 0.001067 | 33 |
| RAPGEF1 | 1.6968 | 34 | 0.001111 | 34 |
| ABLIM2 | 1.6921 | 35 | 0.001241 | 35 |
| GAB2 | 1.69 | 36 | 0.001305 | 36 |
| INHBA | 1.6861 | 37 | 0.001424 | 37 |
| C11orf21 | 1.6851 | 38 | 0.001456 | 38 |
| NEFM | 1.6843 | 39 | 0.001484 | 39 |
| C19orf18 | 1.6841 | 40 | 0.00149 | 40 |
| SLC19A2 | 1.681 | 41 | 0.001591 | 41 |
| DYRK3 | 1.6775 | 42 | 0.001718 | 42 |
| ARHGAP6 | 1.6742 | 43 | 0.001842 | 43 |
| FOXO4 | 1.6723 | 44 | 0.001913 | 44 |
| EIF4EBP2 | 1.6711 | 45 | 0.001955 | 45 |
| TMEM199 | 1.6694 | 46 | 0.002024 | 46 |
| ZCCHC11 | 1.6692 | 47 | 0.00203 | 47 |
| CHID1 | 1.668 | 48 | 0.002082 | 48 |
| MGAT3 | 1.6669 | 49 | 0.002129 | 49 |
| CHST15 | 1.6667 | 50 | 0.002138 | 50 |
| C14orf39 | 1.6649 | 51 | 0.002214 | 51 |
| FSD1 | 1.6636 | 52 | 0.002271 | 52 |
| STAU2 | 1.6629 | 53 | 0.002296 | 53 |
| TRIM65 | 1.6579 | 54 | 0.002526 | 54 |
| JUN | 1.6571 | 55 | 0.002561 | 55 |
| MMRN2 | 1.6555 | 56 | 0.002639 | 56 |
| TMEM129 | 1.6532 | 57 | 0.002748 | 57 |
| BRINP1 | 1.6507 | 58 | 0.002872 | 58 |
| BCL7C | 1.6494 | 59 | 0.002938 | 59 |
| NFS1 | 1.6492 | 60 | 0.002947 | 60 |
| AP4B1 | 1.6487 | 61 | 0.002971 | 61 |
| 41885 | 1.6474 | 62 | 0.003039 | 62 |
| B4GALNT2 | 1.6472 | 63 | 0.003052 | 63 |
| MDK | 1.6447 | 64 | 0.003186 | 64 |

FIG. 84B

| | | | | |
|---|---|---|---|---|
| PABPC5 | 1.6424 | 65 | 0.003309 | 65 |
| TNFRSF1B | 1.6404 | 66 | 0.003425 | 66 |
| MLLT6 | 1.6398 | 67 | 0.003458 | 67 |
| IER3IP1 | 1.6344 | 68 | 0.003784 | 68 |
| PBX1 | 1.6325 | 69 | 0.003907 | 69 |
| BCAS3 | 1.631 | 70 | 0.003993 | 70 |
| HDX | 1.6291 | 71 | 0.00412 | 71 |
| RNF6 | 1.6271 | 72 | 0.00425 | 72 |
| MAP3K11 | 1.6268 | 73 | 0.00427 | 73 |
| CA3 | 1.62 | 74 | 0.004741 | 74 |
| APBB1 | 1.6196 | 75 | 0.004776 | 75 |
| FOXJ1 | 1.6179 | 76 | 0.004905 | 76 |
| LYPD2 | 1.6162 | 77 | 0.005023 | 77 |
| DNASE1L2 | 1.6151 | 78 | 0.005103 | 78 |
| BRI3 | 1.6132 | 79 | 0.005249 | 79 |
| GCK | 1.6112 | 80 | 0.0054 | 80 |
| PRKCE | 1.6081 | 81 | 0.005637 | 81 |
| GCNT1 | 1.6074 | 82 | 0.005693 | 82 |
| CDR2 | 1.6071 | 83 | 0.005713 | 83 |
| DDX11 | 1.6059 | 84 | 0.005807 | 84 |
| SLC2A3 | 1.6015 | 85 | 0.00618 | 85 |
| PAK7 | 1.5993 | 86 | 0.006366 | 86 |
| TCF7L1 | 1.599 | 87 | 0.006387 | 87 |
| SOCS6 | 1.5969 | 88 | 0.006578 | 88 |
| C19orf68 | 1.594 | 89 | 0.006839 | 89 |
| C3orf27 | 1.5938 | 90 | 0.006853 | 90 |
| NBL1 | 1.592 | 91 | 0.007023 | 91 |
| ARHGEF5 | 1.5909 | 92 | 0.007126 | 92 |
| GABRQ | 1.5879 | 93 | 0.007405 | 93 |
| ANKRD29 | 1.5877 | 94 | 0.007428 | 94 |
| ZNF704 | 1.586 | 95 | 0.007587 | 95 |
| RHOG | 1.5853 | 96 | 0.007657 | 96 |
| HOXB4 | 1.5849 | 97 | 0.007701 | 97 |
| CCER1 | 1.5836 | 98 | 0.007833 | 98 |
| ATL1 | 1.5832 | 99 | 0.007874 | 99 |
| RASGRF1 | 1.5831 | 100 | 0.00788 | 100 |

FIG. 84C

TaqMan qPCR probe ID's used to quantify relative RNA expression levels for each gene (Life Technologies)

| Gene | Probe ID |
|---|---|
| ASCL1 | Hs00269932_m1 |
| HBG1/HBG2 | Hs00361131_g1 |
| HOTTIP | Hs00955374_s1 |
| IL1B | Hs01555410_m1 |
| IL1R2 | Hs01030384_m1 |
| KLF4 | Hs00358836_m1 |
| LIN28A | Hs00702808_s1 |
| LINC00028 | Hs04233790_s1 |
| LINC00514 | Hs04273769_m1 |
| LINC00925 | Hs00288663_m1 |
| MYC | Hs00153408_m1 |
| MYOD1 | Hs02330075_g1 |
| NANOG | Hs04260366_g1 |
| NEUROG2 | Mm00437603_g1 |
| PCAT-1 | Hs04275836_s1 |
| POU5F1 | Hs00999632_g1 |
| SOX2 | Hs01053049_s1 |
| TERT | Hs00972656_m1 |
| TINCR | Hs00542141_m1 |
| VEGFA | Hs00900055_m1 |
| ZFP42 | Hs00399279_m1 |

FIG. 85

SYSTEMS, METHODS AND COMPOSITIONS FOR SEQUENCE MANIPULATION WITH OPTIMIZED FUNCTIONAL CRISPR-CAS SYSTEMS

RELATED APPLICATIONS AND INCORPORATION BY REFERENCE

This application is a Continuation-in-Part of International Application Number PCT/US14/70175 filed on Dec. 12, 2014, which published as PCT Publication No. WO2015/089486 on Jun. 18, 2015. This application claims priority from: U.S. provisional patent applications 61/915,251, filed Dec. 12, 2013; 61/930,214 filed Jan. 22, 2014; 61/939,242 filed Feb. 12, 2014; 61/980,012 filed Apr. 15, 2014; 62/055,484 filed Sep. 25, 2014; 62/087,537, filed Dec. 4, 2014; 61/915,267, filed Dec. 12, 2013; and 61/939,256, filed Feb. 12, 2014.

The foregoing applications, and all documents cited therein or during their prosecution ("appln cited documents") and all documents cited or referenced in the appln cited documents, and all documents cited or referenced herein ("herein cited documents"), and all documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

STATEMENT AS TO FEDERALLY SPONSORED RESEARCH

This invention was made with government support under Grant No. MH100706, awarded by the National Institutes of Health. The government has certain rights in the invention.

This invention was made with government support under PRESTO (Precursory Research for Embryonic Science and Technology, Sakigake) in the field of "Structural life science and advanced core technologies for innovative life science research", awarded by JST (Japan Science and Technology Agency) in 2012. JST has certain rights in the invention.

This invention was made with government support under the field of "Development of New CRISPR Cas9 System Set and Its Medical Application", awarded by Ministry of Education, Culture, Sports, Science and Technology (MEXT) in 2014. MEXT has certain rights in the invention.

SEQUENCE LISTING

The instant application contains a Sequence Listing which has been submitted electronically in ASCII format and is hereby incorporated by reference in its entirety. Said ASCII copy created, Jun. 10, 2016, is named 47627.04.2069_SL.txt is 920,860 bytes in size.

FIELD OF INVENTION

The present invention generally relates to systems, methods and compositions used for the control of gene expression involving sequence targeting, such as genome perturbation or gene-editing, that may use vector systems related to Clustered Regularly Interspaced Short Palindromic Repeats (CRISPR) and components thereof. In particular the present invention comprehends optimized functional CRISPR-Cas enzyme systems.

BACKGROUND OF THE INVENTION

Recent advances in genome sequencing techniques and analysis methods have significantly accelerated the ability to catalog and map genetic factors associated with a diverse range of biological functions and diseases. Precise genome targeting technologies are needed to enable systematic reverse engineering of causal genetic variations by allowing selective perturbation of individual genetic elements, as well as to advance synthetic biology, biotechnological, and medical applications. Although genome-editing techniques such as designer zinc fingers, transcription activator-like effectors (TALEs), or homing meganucleases are available for producing targeted genome perturbations, there remains a need for new genome engineering technologies that are affordable, easy to set up, scalable, and amenable to targeting multiple positions within the eukaryotic genome.

SUMMARY OF THE INVENTION

There exists a pressing need for alternative and robust systems and techniques for sequence targeting with a wide array of applications. This invention addresses this need and provides related advantages. The CRISPR/Cas or the CRISPR-Cas system (both terms are used interchangeably throughout this application) does not require the generation of customized proteins to target specific sequences but rather a single Cas enzyme can be programmed by a short RNA molecule to recognize a specific DNA target, in other words the Cas enzyme can be recruited to a specific DNA target using said short RNA molecule. Adding the CRISPR-Cas system to the repertoire of genome sequencing techniques and analysis methods may significantly simplify the methodology and accelerate the ability to catalog and map genetic factors associated with a diverse range of biological functions and diseases. To utilize the CRISPR-Cas system effectively for genome editing without deleterious effects, it is critical to understand aspects of engineering and optimization of these genome engineering tools, which are aspects of the claimed invention.

In an aspect the invention provides a non-naturally occurring or engineered composition comprising a guide RNA (sgRNA) comprising a guide sequence capable of hybridizing to a target sequence in a genomic locus of interest in a cell, wherein at least one loop of the sgRNA is modified by the insertion of distinct RNA sequence(s) that bind to one or more adaptor proteins, and wherein the adaptor protein is associated with one or more functional domains. And when there is more than one functional domain, the functional domains can be same or different, e.g., two of the same or two different activators or repressors. In an aspect the invention provides a non-naturally occurring or engineered CRISPR-Cas complex composition comprising the herein-mentioned sgRNA and a CRISPR enzyme. In an aspect the invention provides a herein-mentioned non-naturally occurring or engineered CRISPR-Cas complex composition wherein: the CRISPR enzyme comprises at least one mutation, such that the CRISPR enzyme has no more than 5% of the nuclease activity of the CRISPR enzyme not having the at least one mutation; and/or at least one or more nuclear localization sequences.

In an aspect the invention provides the herein-mentioned sgRNA or the CRISPR-Cas complex wherein one or more adaptor proteins associated with one or more functional domains is present and bound to the distinct RNA sequence(s) inserted into the at least one loop of the sgRNA.

In an aspect the invention provides a non-naturally occurring or engineered composition comprising: one or more guide RNA (sgRNA) comprising a guide sequence capable of hybridizing to a target sequence in a genomic locus of interest in a cell, a CRISPR enzyme comprising at least one or more nuclear localization sequences, wherein the CRISPR enzyme comprises at least one mutation, such that the CRISPR enzyme has no more than 5% of the nuclease activity of the CRISPR enzyme not having the at least one mutation, wherein at least one loop of at least one sgRNA is modified by the insertion of distinct RNA sequence(s) that bind to one or more adaptor proteins, and wherein the adaptor protein is associated with one or more functional domains.

In an aspect the invention provides any herein-mentioned composition wherein the CRISPR enzyme has a diminished nuclease activity of at least 97%, or 100% as compared with the CRISPR enzyme not having the at least one mutation. In an aspect the invention provides any aforementioned composition wherein the CRISPR enzyme comprises two or more mutations wherein two or more of D10, E762, H840, N854, N863, or D986 according to SpCas9 protein or any corresponding ortholog or N580 according to SaCas9 protein are mutated, or the CRISPR enzyme comprises at least one mutation wherein at least H840 is mutated. In an aspect the invention provides a herein-mentioned composition wherein the CRISPR enzyme comprises two or more mutations comprising D10A, E762A, H840A, N854A, N863A or D986A according to SpCas9 protein or any corresponding ortholog, or N580A according to SaCas9 protein, or at least one mutation comprising H840A. In an aspect the invention provides any herein-mentioned composition wherein the CRISPR enzyme comprises H840A, or D10A and H840A, or D10A and N863A, according to SpCas9 protein or any corresponding ortholog. In an aspect the invention provides any herein-mentioned composition wherein the CRISPR enzyme comprises: N580A according to SaCas9 protein or any corresponding ortholog; or D10A according to SpCas9 protein, or any corresponding ortholog, and N580A according to SaCas9 protein.

In an aspect the invention provides any herein-mentioned composition wherein the CRISPR enzyme is associated with one or more functional domains. In an aspect the invention provides any herein-mentioned composition wherein the one or more functional domains associated with the adaptor protein is a heterologous functional domain. In an aspect the invention provides any herein-mentioned composition wherein the one or more functional domains associated with the CRISPR enzyme is a heterologous functional domain.

In an aspect the invention provides a composition as herein discussed, wherein the adaptor protein is a fusion protein comprising the functional domain, the fusion protein optionally comprising a linker between the adaptor protein and the functional domain, the linker optionally including a GlySer linker.

In an aspect the invention provides a composition as herein discussed composition of any one of the preceding claims, wherein the at least one loop of the sgRNA is not modified by the insertion of distinct RNA sequence(s) that bind to one or more adaptor proteins and wherein, optionally one of the unmodified sgRNA loops is either one of the tetraloop or the stem-loop 2.

In an aspect the invention provides a composition as herein discussed wherein the one or more functional domains associated with the adaptor protein is a transcriptional activation domain.

In an aspect the invention provides a composition as herein discussed wherein the one or more functional domains associated with the CRISPR enzyme is a transcriptional activation domain.

In an aspect the invention provides a composition as herein discussed wherein the one or more functional domains associated with the adaptor protein is a transcriptional activation domain comprising VP64, p65, MyoD1, HSF1, RTA or SET7/9. Other references herein to activation (or activator) domains in respect of those associated with the adaptor protein(s) include any known transcriptional activation domain and specifically VP64, p65, MyoD1, HSF1, RTA or SET7/9.

In an aspect the invention provides a composition as herein discussed wherein the one or more functional domains associated with the CRISPR enzyme is a transcriptional activation domain comprises VP64, p65, MyoD1, HSF1, RTA and SET7/9. Other references herein to activation (or activator) domains in respect of those associated with the CRISPR enzyme include any known transcriptional activation domain and specifically VP64, p65, MyoD1, HSF1, RTA or SET7/9.

In an aspect the invention provides a composition as herein discussed wherein the one or more functional domains associated with the adaptor protein is a transcriptional repressor domain.

In an aspect the invention provides a composition as herein discussed wherein the one or more functional domains associated with the CRISPR enzyme is a transcriptional repressor domain.

In an aspect the invention provides a composition as herein discussed wherein the transcriptional repressor domain is a KRAB domain.

In an aspect the invention provides a composition as herein discussed wherein the transcriptional repressor domain is a NuE domain, NcoR domain, SID domain or a SID4X domain.

In an aspect the invention provides a composition as herein discussed wherein the one or more functional domains associated with the adaptor protein have one or more activities comprising methylase activity, demethylase activity, transcription activation activity, transcription repression activity, transcription release factor activity, histone modification activity, RNA cleavage activity, DNA cleavage activity, DNA integration activity or nucleic acid binding activity.

In an aspect the invention provides a composition as herein discussed wherein the one or more functional domains associated with the CRISPR enzyme have one or more activities comprising methylase activity, demethylase activity, transcription activation activity, transcription repression activity, transcription release factor activity, histone modification activity, RNA cleavage activity, DNA cleavage activity, DNA integration activity, nucleic acid binding activity, or molecular switch activity or chemical inducibility or light inducibility.

Histone modifying domains are also preferred in some embodiments. Exemplary histone modifying domains are discussed below. Transposase domains, HR (Homologous Recombination) machinery domains, recombinase domains, and/or integrase domains are also preferred as the present functional domains. In some embodiments, DNA integration activity includes HR machinery domains, integrase domains, recombinase domains and/or transposase domains.

In an aspect the invention provides a composition as herein discussed wherein the DNA cleavage activity is due to a nuclease In an aspect the invention provides a composition as herein discussed wherein the nuclease comprises a Fok1 nuclease.

In an aspect the invention provides a composition as herein discussed wherein the one or more functional domains is attached to the CRISPR enzyme so that upon binding to the sgRNA and target the functional domain is in a spatial orientation allowing for the functional domain to function in its attributed function.

In an aspect the invention provides a composition as herein discussed wherein the one or more functional domains is attached to the CRISPR enzyme via a linker, optionally a GlySer linker. In an aspect the invention provides a composition as herein discussed, wherein the sgRNA is modified so that, after sgRNA binds the adaptor protein and further binds to the CRISPR enzyme and target, the functional domain is in a spatial orientation allowing for the functional domain to function in its attributed function.

In an aspect the invention provides a composition as herein discussed wherein the at least one loop of the sgRNA is tetraloop and/or loop2.

In an aspect the invention provides a composition as herein discussed wherein the tetraloop and loop 2 of the sgRNA are modified by the insertion of the distinct RNA sequence(s).

In an aspect the invention provides a composition as herein discussed wherein the insertion of distinct RNA sequence(s) that bind to one or more adaptor proteins is an aptamer sequence.

In an aspect the invention provides a composition as herein discussed wherein the aptamer sequence is two or more aptamer sequences specific to the same adaptor protein.

In an aspect the invention provides a composition as herein discussed wherein the aptamer sequence is two or more aptamer sequences specific to different adaptor proteins.

In an aspect the invention provides a composition as herein discussed wherein the adaptor protein comprises MS2, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, PRR1.

In an aspect the invention provides a composition as herein discussed wherein the cell is a eukaryotic cell, optionally a mammalian cell.

In an aspect the invention provides a composition as herein discussed wherein the cell is a human cell or a mouse cell.

In an aspect the invention provides a mammalian cell as herein discussed, e.g., wherein the cell comprises a cell line and is, optionally, a human cell line or a mouse cell line.

In an aspect the invention provides a transgenic mammalian model, optionally a mouse, e.g., wherein the model has been transformed with a composition as herein discussed or is progeny of said transformant.

In an aspect the invention provides a method for introducing a genomic locus event comprising the administration of to a host or expression in a host one or more of the compositions as herein discussed.

In an aspect the invention provides a method as herein discussed, wherein the genomic locus event comprises affecting gene activation, gene inhibition, or cleavage in the locus, or insertion of DNA.

In an aspect the invention provides a method as herein discussed, comprising the delivery of the composition or nucleic acid molecule(s) coding therefor, wherein said nucleic acid molecule(s) are operatively linked to regulatory sequence(s) and expressed in vivo. Expression in vivo can be via a lentivirus, an adenovirus, or an AAV.

In an aspect the invention provides a vector comprising: a nucleic acid molecule encoding a guide RNA (sgRNA), comprising a regulatory element operable in a eukaryotic cell including a guide sequence (sgRNA) operably linked to a promoter, the sgRNA being capable of hybridizing to a target sequence in a genomic locus of interest in a cell, wherein at least one loop of the sgRNA is modified by the insertion of distinct RNA sequence(s) that bind to one or more adaptor proteins.

In an aspect the invention provides a vector comprising a regulatory element operable in a eukaryotic cell including a nucleic acid molecule encoding a CRISPR enzyme operably linked to a promoter, the enzyme comprising at least one or more nuclear localization sequences, wherein the CRISPR enzyme comprises at least one mutation, such that the CRISPR enzyme has no more than 5% of the nuclease activity of the CRISPR enzyme not having the at least one mutation, and wherein the CRISPR enzyme is associated with one or more functional domains.

In an aspect the invention provides nucleic acid molecule(s) encoding sgRNA or the CRISPR-Cas complex or a composition as herein discussed.

In an aspect the invention provides a method of screening for gain of function (GOF) or loss of function (LOF) comprising the cell line or cells of the model herein-discussed containing or expressing Cas9 and introducing a composition of claim 1 into cells of the cell line or model, whereby the sgRNA includes either an activator or a repressor, and monitoring for GOF or LOF respectively as to those cells as to which the introduced sgRNA includes an activator or as to those cells as to which the introduced sgRNA includes a repressor.

In an aspect there is provided a CRISPR Cas complex comprising a CRISPR enzyme and a guide RNA (sgRNA), wherein the CRISPR enzyme comprises at least one mutation, such that the CRISPR enzyme has no more than 5% of the nuclease activity of the CRISPR enzyme not having the at least one mutation and, optional, at least one or more nuclear localization sequences; the guide RNA (sgRNA) comprises a guide sequence capable of hybridizing to a target sequence in a genomic locus of interest in a cell; and wherein: the CRISPR enzyme is associated with two or more functional domains, which may be the same or different, and are preferably different functional domains; or at least one loop of the sgRNA is modified by the insertion of distinct RNA sequence(s) that bind to one or more adaptor proteins, and wherein the adaptor protein is associated with two or more functional domains; or the CRISPR enzyme is associated with one or more functional domains and at least one loop of the sgRNA is modified by the insertion of distinct RNA sequence(s) that bind to one or more adaptor proteins, and wherein the adaptor protein is associated with one or more functional domains.

In an aspect the invention provides a herein-discussed composition wherein the CRISPR enzyme includes one or more functional domains. In such a composition there can be more than one sgRNA, and the sgRNAs target different sequences whereby when the composition is employed, there is multiplexing. The composition can include more than one sgRNA modified by the insertion of distinct RNA sequence(s) that bind to one or more adaptor proteins. The composition can involve wherein one or more adaptor proteins associated with one or more functional domains is present and bound to the distinct RNA sequence(s) inserted into the at least one loop of the sgRNA.

In one aspect, the invention provides a method for altering or modifying expression of a gene product. The said method may comprise introducing into a cell containing and expressing a DNA molecule encoding the gene product an engineered, non-naturally occurring CRISPR-Cas system comprising a Cas protein and guide RNA that targets the DNA molecule, whereby the guide RNA targets the DNA molecule encoding the gene product and the Cas protein cleaves the DNA molecule encoding the gene product, whereby expression of the gene product is altered; and, wherein the Cas protein and the guide RNA do not naturally occur together. The invention comprehends the guide RNA comprising a guide sequence fused to a tracr sequence. The invention further comprehends the Cas protein being codon optimized for expression in a Eukaryotic cell. In a preferred embodiment the Eukaryotic cell is a mammalian cell and in a more preferred embodiment the mammalian cell is a human cell. In a further embodiment of the invention, the expression of the gene product is decreased.

In an aspect, in herein-discussed compositions, the target sequence(s) can be non-coding or regulatory (including promoter, especially the proximal promoter) or enhancer or silencer sequence(s).

In one aspect, the invention provides an engineered, non-naturally occurring CRISPR-Cas system comprising a Cas protein and a guide RNA that targets a DNA molecule encoding a gene product in a cell, whereby the guide RNA targets the DNA molecule encoding the gene product and the Cas protein cleaves the DNA molecule encoding the gene product, whereby expression of the gene product is altered; and, wherein the Cas protein and the guide RNA do not naturally occur together. The invention comprehends the guide RNA comprising a guide sequence fused to a tracr sequence. In an embodiment of the invention the Cas protein is a type II CRISPR-Cas protein and in a preferred embodiment the Cas protein is a Cas9 protein. The invention further comprehends the Cas protein being codon optimized for expression in a Eukaryotic cell. In a preferred embodiment the Eukaryotic cell is a mammalian cell and in a more preferred embodiment the mammalian cell is a human cell. In a further embodiment of the invention, the expression of the gene product is decreased.

In another aspect, the invention provides an engineered, non-naturally occurring vector system comprising one or more vectors comprising a first regulatory element operably linked to a CRISPR-Cas system guide RNA that targets a DNA molecule encoding a gene product and a second regulatory element operably linked to a Cas protein. Components (a) and (b) may be located on same or different vectors of the system. The guide RNA targets the DNA molecule encoding the gene product in a cell and the Cas protein cleaves the DNA molecule encoding the gene product, whereby expression of the gene product is altered; and, wherein the Cas protein and the guide RNA do not naturally occur together. The invention comprehends the guide RNA comprising a guide sequence fused to a tracr sequence. In an embodiment of the invention the Cas protein is a type II CRISPR-Cas protein and in a preferred embodiment the Cas protein is a Cas9 protein. The invention further comprehends the Cas protein being codon optimized for expression in a Eukaryotic cell. In a preferred embodiment the Eukaryotic cell is a mammalian cell and in a more preferred embodiment the mammalian cell is a human cell. In a further embodiment of the invention, the expression of the gene product is decreased.

In one aspect, the invention provides a vector system comprising one or more vectors. In some embodiments, the system comprises: (a) a first regulatory element operably linked to a tracr mate sequence and one or more insertion sites for inserting one or more guide sequences upstream of the tracr mate sequence, wherein when expressed, the guide sequence directs sequence-specific binding of a CRISPR complex to a target sequence in a eukaryotic cell, wherein the CRISPR complex comprises a CRISPR enzyme complexed with (1) the guide sequence that is hybridized to the target sequence, and (2) the tracr mate sequence that is hybridized to the tracr sequence; and (b) a second regulatory element operably linked to an enzyme-coding sequence encoding said CRISPR enzyme comprising a nuclear localization sequence; wherein components (a) and (b) are located on the same or different vectors of the system. In some embodiments, component (a) further comprises the tracr sequence downstream of the tracr mate sequence under the control of the first regulatory element. In some embodiments, component (a) further comprises two or more guide sequences operably linked to the first regulatory element, wherein when expressed, each of the two or more guide sequences direct sequence specific binding of a CRISPR complex to a different target sequence in a eukaryotic cell. In some embodiments, the system comprises the tracr sequence under the control of a third regulatory element, such as a polymerase III promoter. In some embodiments, the tracr sequence exhibits at least 50%, 60%, 70%, 80%, 90%, 95%, or 99% of sequence complementarity along the length of the tracr mate sequence when optimally aligned. Determining optimal alignment is within the purview of one of skill in the art. For example, there are publically and commercially available alignment algorithms and programs such as, but not limited to, ClustalW, Smith-Waterman in matlab, Bowtie, Geneious, Biopython and SeqMan. In some embodiments, the CRISPR complex comprises one or more nuclear localization sequences of sufficient strength to drive accumulation of said CRISPR complex in a detectable amount in the nucleus of a eukaryotic cell. Without wishing to be bound by theory, it is believed that a nuclear localization sequence is not necessary for CRISPR complex activity in eukaryotes, but that including such sequences enhances activity of the system, especially as to targeting nucleic acid molecules in the nucleus. In some embodiments, the CRISPR enzyme is a type II CRISPR system enzyme. In some embodiments, the CRISPR enzyme is a Cas9 enzyme. In some embodiments, the Cas9 enzyme is *S. pneumoniae, S. pyogenes*, or *S. thermophilus* Cas9, and may include mutated Cas9 derived from these organisms. The enzyme may be a Cas9 homolog or ortholog. In some embodiments, the CRISPR enzyme is codon-optimized for expression in a eukaryotic cell. In some embodiments, the CRISPR enzyme directs cleavage of one or two strands at the location of the target sequence. In some embodiments, the first regulatory element is a polymerase III promoter. In some embodiments, the second regulatory element is a polymerase II promoter. In some embodiments, the guide sequence is at least 15, 16, 17, 18, 19, 20, 25 nucleotides, or between 10-30, or between 15-25, or between 15-20 nucleotides in length. In general, and throughout this specification, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell).

The term "regulatory element" is intended to include promoters, enhancers, internal ribosomal entry sites (IRES), and other expression control elements (e.g. transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g. liver, pancreas), or particular cell types (e.g. lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g. 1, 2, 3, 4, 5, or more pol I promoters), one or more pol II promoters (e.g. 1, 2, 3, 4, 5, or more pol II promoters), one or more pol I promoters (e.g. 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.).

Advantageous vectors include lentiviruses and adeno-associated viruses, and types of such vectors can also be selected for targeting particular types of cells.

In one aspect, the invention provides a eukaryotic host cell comprising (a) a first regulatory element operably linked to a tracr mate sequence and one or more insertion sites for inserting one or more guide sequences upstream of the tracr mate sequence, wherein when expressed, the guide sequence directs sequence-specific binding of a CRISPR complex to a target sequence in a eukaryotic cell, wherein the CRISPR complex comprises a CRISPR enzyme complexed with (1) the guide sequence that is hybridized to the target sequence, and (2) the tracr mate sequence that is hybridized to the tracr sequence; and/or (b) a second regulatory element operably linked to an enzyme-coding sequence encoding said CRISPR enzyme comprising a nuclear localization sequence. In some embodiments, the host cell comprises components (a) and (b). In some embodiments, component (a), component (b), or components (a) and (b) are stably integrated into a genome of the host eukaryotic cell. In some embodiments, component (a) further comprises the tracr sequence downstream of the tracr mate sequence under the control of the first regulatory element. In some embodiments, component (a) further comprises two or more guide sequences operably linked to the first regulatory element, wherein when expressed, each of the two or more guide sequences direct sequence specific binding of a CRISPR complex to a different target sequence in a eukaryotic cell. In some embodiments, the eukaryotic host cell further comprises a third regulatory element, such as a polymerase III promoter, operably linked to said tracr sequence. In some embodiments, the tracr sequence exhibits at least 50%, 60%, 70%, 80%, 90%, 95%, or 99% of sequence complementarity along the length of the tracr mate sequence when optimally aligned. The enzyme may be a Cas9 homolog or ortholog. In some embodiments, the CRISPR enzyme is codon-optimized for expression in a eukaryotic cell. In some embodiments, the CRISPR enzyme directs cleavage of one or two strands at the location of the target sequence. In some embodiments, the CRISPR enzyme lacks DNA strand cleavage activity. In some embodiments, the first regulatory element is a polymerase III promoter. In some embodiments, the second regulatory element is a polymerase II promoter. In some embodiments, the guide sequence is at least 15, 16, 17, 18, 19, 20, 25 nucleotides, or between 10-30, or between 15-25, or between 15-20 nucleotides in length. In an aspect, the invention provides a non-human eukaryotic organism; preferably a multicellular eukaryotic organism, comprising a eukaryotic host cell according to any of the described embodiments. In other aspects, the invention provides a eukaryotic organism; preferably a multicellular eukaryotic organism, comprising a eukaryotic host cell according to any of the described embodiments. The organism in some embodiments of these aspects may be an animal; for example a mammal. Also, the organism may be an arthropod such as an insect. The organism also may be a plant. Further, the organism may be a fungus.

In one aspect, the invention provides a kit comprising one or more of the components described herein. In some embodiments, the kit comprises a vector system and instructions for using the kit. In some embodiments, the vector system comprises (a) a first regulatory element operably linked to a tracr mate sequence and one or more insertion sites for inserting one or more guide sequences upstream of the tracr mate sequence, wherein when expressed, the guide sequence directs sequence-specific binding of a CRISPR complex to a target sequence in a eukaryotic cell, wherein the CRISPR complex comprises a CRISPR enzyme complexed with (1) the guide sequence that is hybridized to the target sequence, and (2) the tracr mate sequence that is hybridized to the tracr sequence; and/or (b) a second regulatory element operably linked to an enzyme-coding sequence encoding said CRISPR enzyme comprising a nuclear localization sequence. In some embodiments, the kit comprises components (a) and (b) located on the same or different vectors of the system. In some embodiments, component (a) further comprises the tracr sequence downstream of the tracr mate sequence under the control of the first regulatory element. In some embodiments, component (a) further comprises two or more guide sequences operably linked to the first regulatory element, wherein when expressed, each of the two or more guide sequences direct sequence specific binding of a CRISPR complex to a different target sequence in a eukaryotic cell. In some embodiments, the system further comprises a third regulatory element, such as a polymerase III promoter, operably linked to said tracr sequence. In some embodiments, the tracr sequence exhibits at least 50%, 60%, 70%, 80%, 90%, 95%, or 99% of sequence complementarity along the length of the tracr mate sequence when optimally aligned. In some embodiments, the CRISPR enzyme comprises one or more nuclear localization sequences of sufficient strength to drive accumulation of said CRISPR enzyme in a detectable amount in the nucleus of a eukaryotic cell. In some embodiments, the CRISPR enzyme is a type II CRISPR system enzyme. In some embodiments, the CRISPR enzyme is a Cas9 enzyme. In some embodiments, the Cas9 enzyme is S. pneumoniae, S. pyogenes or S. thermophilus Cas9, and may include mutated Cas9 derived from these organisms. The enzyme may be a Cas9 homolog or ortholog. In some embodiments, the CRISPR enzyme is codon-optimized for expression in a eukaryotic cell. In some embodiments, the CRISPR enzyme directs cleavage of one or two strands at the location of the target sequence. In some embodiments, the CRISPR enzyme lacks DNA strand cleavage activity. In some embodiments, the first regulatory element is a polymerase III promoter. In some embodiments, the second regulatory element is a polymerase II promoter. In some embodiments, the guide sequence is at least 15, 16, 17, 18, 19, 20, 25 nucleotides, or between 10-30, or between 15-25, or between 15-20 nucleotides in length.

In one aspect, the invention provides a method of modifying a target polynucleotide in a eukaryotic cell. In some embodiments, the method comprises allowing a CRISPR complex to bind to the target polynucleotide to effect cleavage of said target polynucleotide thereby modifying the target polynucleotide, wherein the CRISPR complex comprises a CRISPR enzyme complexed with a guide sequence hybridized to a target sequence within said target polynucleotide, wherein said guide sequence is linked to a tracr mate sequence which in turn hybridizes to a tracr sequence. In some embodiments, said cleavage comprises cleaving one or two strands at the location of the target sequence by said CRISPR enzyme. In some embodiments, said cleavage results in decreased transcription of a target gene. In some embodiments, the method further comprises repairing said cleaved target polynucleotide by homologous recombination with an exogenous template polynucleotide, wherein said repair results in a mutation comprising an insertion, deletion, or substitution of one or more nucleotides of said target polynucleotide. In some embodiments, said mutation results in one or more amino acid changes in a protein expressed from a gene comprising the target sequence. In some embodiments, the method further comprises delivering one or more vectors to said eukaryotic cell, wherein the one or more vectors drive expression of one or more of: the CRISPR enzyme, the guide sequence linked to the tracr mate sequence, and the tracr sequence. In some embodiments, said vectors are delivered to the eukaryotic cell in a subject. In some embodiments, said modifying takes place in said eukaryotic cell in a cell culture. In some embodiments, the method further comprises isolating said eukaryotic cell from a subject prior to said modifying. In some embodiments, the method further comprises returning said eukaryotic cell and/or cells derived therefrom to said subject.

In one aspect, the invention provides a method of modifying expression of a polynucleotide in a eukaryotic cell. In some embodiments, the method comprises allowing a CRISPR complex to bind to the polynucleotide such that said binding results in increased or decreased expression of said polynucleotide; wherein the CRISPR complex comprises a CRISPR enzyme complexed with a guide sequence hybridized to a target sequence within said polynucleotide, wherein said guide sequence is linked to a tracr mate sequence which in turn hybridizes to a tracr sequence. In some embodiments, the method further comprises delivering one or more vectors to said eukaryotic cells, wherein the one or more vectors drive expression of one or more of: the CRISPR enzyme, the guide sequence linked to the tracr mate sequence, and the tracr sequence.

In one aspect, the invention provides a method of generating a model eukaryotic cell comprising a mutated disease gene. In some embodiments, a disease gene is any gene associated an increase in the risk of having or developing a disease. In some embodiments, the method comprises (a) introducing one or more vectors into a eukaryotic cell, wherein the one or more vectors drive expression of one or more of: a CRISPR enzyme, a guide sequence linked to a tracr mate sequence, and a tracr sequence; and (b) allowing a CRISPR complex to bind to a target polynucleotide to effect cleavage of the target polynucleotide within said disease gene, wherein the CRISPR complex comprises the CRISPR enzyme complexed with (1) the guide sequence that is hybridized to the target sequence within the target polynucleotide, and (2) the tracr mate sequence that is hybridized to the tracr sequence, thereby generating a model eukaryotic cell comprising a mutated disease gene. In some embodiments, said cleavage comprises cleaving one or two strands at the location of the target sequence by said CRISPR enzyme. In some embodiments, said cleavage results in decreased transcription of a target gene. In some embodiments, the method further comprises repairing said cleaved target polynucleotide by homologous recombination with an exogenous template polynucleotide, wherein said repair results in a mutation comprising an insertion, deletion, or substitution of one or more nucleotides of said target polynucleotide. In some embodiments, said mutation results in one or more amino acid changes in a protein expression from a gene comprising the target sequence.

In one aspect, the invention provides a method for developing a biologically active agent that modulates a cell signaling event associated with a disease gene. In some embodiments, a disease gene is any gene associated with an increase in the risk of having or developing a disease. In some embodiments, the method comprises (a) contacting a test compound with a model cell of any one of the described embodiments; and (b) detecting a change in a readout that is indicative of a reduction or an augmentation of a cell signaling event associated with said mutation in said disease gene, thereby developing said biologically active agent that modulates said cell signaling event associated with said disease gene.

In one aspect, the invention provides a recombinant polynucleotide comprising a guide sequence upstream of a tracr mate sequence, wherein the guide sequence when expressed directs sequence-specific binding of a CRISPR complex to a corresponding target sequence present in a eukaryotic cell. In some embodiments, the target sequence is a viral sequence present in a eukaryotic cell. In some embodiments, the target sequence is a proto-oncogene or an oncogene.

In one aspect the invention provides for a method of selecting one or more cell(s) by introducing one or more mutations in a gene in the one or more cell (s), the method comprising: introducing one or more vectors into the cell (s), wherein the one or more vectors drive expression of one or more of: a CRISPR enzyme, a guide sequence linked to a tracr mate sequence, a tracr sequence, and an editing template; wherein the editing template comprises the one or more mutations that abolish CRISPR enzyme cleavage; allowing homologous recombination of the editing template with the target polynucleotide in the cell(s) to be selected; allowing a CRISPR complex to bind to a target polynucleotide to effect cleavage of the target polynucleotide within said gene, wherein the CRISPR complex comprises the CRISPR enzyme complexed with (1) the guide sequence that is hybridized to the target sequence within the target polynucleotide, and (2) the tracr mate sequence that is hybridized to the tracr sequence, wherein binding of the CRISPR complex to the target polynucleotide induces cell death, thereby allowing one or more cell(s) in which one or more mutations have been introduced to be selected. In a preferred embodiment, the CRISPR enzyme is Cas9. In another preferred embodiment of the invention the cell to be selected may be a eukaryotic cell. Aspects of the invention allow for selection of specific cells without requiring a selection marker or a two-step process that may include a counter-selection system.

In another aspect the invention comprehends a CRISPR-Cas9 (*S. pyogenes*) system having an X-ray diffraction pattern corresponding to or resulting from any or all of the foregoing and/or a crystal having the structure defined by the co-ordinates of the Crystal Structure Table in Example 8 (the CRISPR-cas9 crystal structure) or as further described in Example 12.

In a further aspect, the invention involves a computer-assisted method for identifying or designing potential compounds to fit within or bind to CRISPR-Cas9 system or a functional portion thereof or vice versa (a computer-assisted method for identifying or designing potential CRISPR-Cas9 systems or a functional portion thereof for binding to desired compounds) or a computer-assisted method for identifying or designing potential CRISPR-Cas9 systems (e.g., with regard to predicting areas of the CRISPR-Cas9 system to be able to be manipulated—for instance, based on crystal structure data or based on data of Cas9 orthologs, or with respect to where a functional group such as an activator or repressor can be attached to the CRISPR-Cas9 system, or as to Cas9 truncations or as to designing nickases), said method comprising:

using a computer system, e.g., a programmed computer comprising a processor, a data storage system, an input device, and an output device, the steps of:

(a) inputting into the programmed computer through said input device data comprising the three-dimensional co-ordinates of a subset of the atoms from or pertaining to the CRISPR-Cas9 crystal structure, e.g., in the CRISPR-Cas9 system binding domain or alternatively or additionally in domains that vary based on variance among Cas9 orthologs or as to Cas9s or as to nickases or as to functional groups, optionally with structural information from CRISPR-Cas9 system complex(es), thereby generating a data set;

(b) comparing, using said processor, said data set to a computer database of structures stored in said computer data storage system, e.g., structures of compounds that bind or putatively bind or that are desired to bind to a CRISPR-Cas9 system or as to Cas9 orthologs (e.g., as Cas9s or as to domains or regions that vary amongst Cas9 orthologs) or as to the CRISPR-Cas9 crystal structure or as to nickases or as to functional groups;

(c) selecting from said database, using computer methods, structure(s)—e.g., CRISPR-Cas9 structures that may bind to desired structures, desired structures that may bind to certain CRISPR-Cas9 structures, portions of the CRISPR-Cas9 system that may be manipulated, e.g., based on data from other portions of the CRISPR-Cas9 crystal structure and/or from Cas9 orthologs, truncated Cas9s, novel nickases or particular functional groups, or positions for attaching functional groups or functional-group-CRISPR-Cas9 systems;

(d) constructing, using computer methods, a model of the selected structure(s); and (e) outputting to said output device the selected structure(s);

and optionally synthesizing one or more of the selected structure(s);

and further optionally testing said synthesized selected structure(s) as or in a CRISPR-Cas9 system;

or, said method comprising: providing the co-ordinates of at least two atoms of the CRISPR-Cas9 crystal structure, e.g., at least two atoms of the herein Crystal Structure Table of the CRISPR-Cas9 crystal structure or co-ordinates of at least a sub-domain of the CRISPR-Cas9 crystal structure ("selected co-ordinates"), providing the structure of a candidate comprising a binding molecule or of portions of the CRISPR-Cas9 system that may be manipulated, e.g., based on data from other portions of the CRISPR-Cas9 crystal structure and/or from Cas9 orthologs, or the structure of functional groups, and fitting the structure of the candidate to the selected co-ordinates, to thereby obtain product data comprising CRISPR-Cas9 structures that may bind to desired structures, desired structures that may bind to certain CRISPR-Cas9 structures, portions of the CRISPR-Cas9 system that may be manipulated, truncated Cas9s, novel nickases, or particular functional groups, or positions for attaching functional groups or functional-group-CRISPR-Cas9 systems, with output thereof; and optionally synthesizing compound(s) from said product data and further optionally comprising testing said synthesized compound(s) as or in a CRISPR-Cas9 system.

The testing can comprise analyzing the CRISPR-Cas9 system resulting from said synthesized selected structure(s), e.g., with respect to binding, or performing a desired function.

The output in the foregoing methods can comprise data transmission, e.g., transmission of information via telecommunication, telephone, video conference, mass communication, e.g., presentation such as a computer presentation (eg POWERPOINT), internet, email, documentary communication such as a computer program (eg WORD) document and the like. Accordingly, the invention also comprehends computer readable media containing: atomic co-ordinate data according to the herein Crystal Structure Table and/or the Figures, said data defining the three dimensional structure of CRISPR-Cas9 or at least one sub-domain thereof, or structure factor data for CRISPR-Cas9, said structure factor data being derivable from the atomic co-ordinate data of herein Crystal Structure Table and/or the Figures. The computer readable media can also contain any data of the foregoing methods. The invention further comprehends methods a computer system for generating or performing rational design as in the foregoing methods containing either: atomic co-ordinate data according to herein Crystal Structure Table and/or the Figures, said data defining the three dimensional structure of CRISPR-Cas9 or at least one sub-domain thereof, or structure factor data for CRISPR-Cas9, said structure factor data being derivable from the atomic co-ordinate data of herein Crystal Structure Table and/or the Figures. The invention further comprehends a method of doing business comprising providing to a user the computer system or the media or the three dimensional structure of CRISPR-Cas9 or at least one sub-domain thereof, or structure factor data for CRISPR-Cas9, said structure set forth in and said structure factor data being derivable from the atomic co-ordinate data of herein Crystal Structure Table and/or the Figures, or the herein computer media or a herein data transmission.

A "binding site" or an "active site" comprises or consists essentially of a site (such as an atom, a functional group of an amino acid residue or a plurality of such atoms and/or groups) in a binding cavity or region, which may bind to a compound such as a nucleic acid molecule, which is/are involved in binding.

By "fitting", is meant determining by automatic, or semi-automatic means, interactions between one or more atoms of a candidate molecule and at least one atom of a structure of the invention, and calculating the extent to which such interactions are stable. Interactions include attraction and repulsion, brought about by charge, steric considerations and the like. Various computer-based methods for fitting are described further By "root mean square (or rms) deviation", we mean the square root of the arithmetic mean of the squares of the deviations from the mean.

By a "computer system", is meant the hardware means, software means and data storage means used to analyze atomic coordinate data. The minimum hardware means of the computer-based systems of the present invention typically comprises a central processing unit (CPU), input means, output means and data storage means. Desirably a display or monitor is provided to visualize structure data. The data storage means may be RAM or means for accessing computer readable media of the invention. Examples of such systems are computer and tablet devices running Unix, Windows or Apple operating systems.

By "computer readable media", is meant any medium or media, which can be read and accessed directly or indirectly by a computer e.g. so that the media is suitable for use in the above-mentioned computer system. Such media include, but are not limited to: magnetic storage media such as floppy discs, hard disc storage medium and magnetic tape; optical storage media such as optical discs or CD-ROM; electrical storage media such as RAM and ROM; thumb drive devices; cloud storage devices and hybrids of these categories such as magnetic/optical storage media.

In particular embodiments of the invention, the conformational variations in the crystal structures of the CRISPR-Cas9 system or of components of the CRISPR-Cas9 provide important and critical information about the flexibility or movement of protein structure regions relative to nucleotide (RNA or DNA) structure regions that may be important for CRISPR-Cas system function. The structural information provided for Cas9 (e.g. *S. pyogenes* Cas9) as the CRISPR enzyme in the present application may be used to further engineer and optimize the CRISPR-Cas system and this may be extrapolated to interrogate structure-function relationships in other CRISPR enzyme systems as well, e.g, other Type II CRISPR enzyme systems.

The invention comprehends optimized functional CRISPR-Cas enzyme systems, especially in combination with the present modified guides and also where the CRISPR enzyme is also associated with a functional domain. In particular, the CRISPR enzyme comprises one or more mutations that converts it to a DNA binding protein to which functional domains exhibiting a function of interest may be recruited or appended or inserted or attached. In certain embodiments, the CRISPR enzyme comprises one or more mutations which include but are not limited to D10A, E762A, H840A, N854A, N863A or D986A (based on the amino acid position numbering of a *S. pyogenes* Cas9) and/or the one or more mutations is in a RuvC1 or HNH domain of the CRISPR enzyme or is a mutation as otherwise as discussed herein. In some embodiments, the CRISPR enzyme has one or more mutations in a catalytic domain, wherein when transcribed, the tracr mate sequence hybridizes to the tracr sequence and the guide sequence directs sequence-specific binding of a CRISPR complex to the target sequence, and wherein the enzyme further comprises a functional domain. In some embodiments, a mutation at N580 according to SaCas9 protein is preferred. In particular, it is preferred in place of the mutation, in Sa Cas9, corresponding to H840 in Sp Cas9. In some embodiments, in Sa Cas9, mutation at D10 and N580 are preferred. In some embodiments, the N580 mutation may be N580A according to SaCas9 protein. It is believed, without being bound by theory, that this is a more predictable mutation for protein function than the H840A equivalent, which may change binding behaviour.

The structural information provided herein allows for interrogation of sgRNA (or chimeric RNA) interaction with the target DNA and the CRISPR enzyme (e.g. Cas9) permitting engineering or alteration of sgRNA structure to optimize functionality of the entire CRISPR-Cas system. For example, loops of the sgRNA may be extended, without colliding with the Cas9 protein by the insertion of adaptor proteins that can bind to RNA. These adaptor proteins can further recruit effector proteins or fusions which comprise one or more functional domains.

In some preferred embodiments, the functional domain is a transcriptional activation domain, preferably VP64. In some embodiments, the functional domain is a transcription repression domain, preferably KRAB. In some embodiments, the transcription repression domain is SID, or concatemers of SID (e.g. SID4X). In some embodiments, the functional domain is an epigenetic modifying domain, such that an epigenetic modifying enzyme is provided. In some embodiments, the functional domain is an activation domain, which may be the P65 activation domain.

Aspects of the invention encompass a non-naturally occurring or engineered composition that may comprise a guide RNA (sgRNA) comprising a guide sequence capable of hybridizing to a target sequence in a genomic locus of interest in a cell and a CRISPR enzyme that may comprise at least one or more nuclear localization sequences, wherein the CRISPR enzyme comprises two or more mutations, such that the enzyme has altered or diminished nuclease activity compared with the wild type enzyme, wherein at least one loop of the sgRNA is modified by the insertion of distinct RNA sequence(s) that bind to one or more adaptor proteins, and wherein the adaptor protein further recruits one or more heterologous functional domains. In an embodiment of the invention the CRISPR enzyme comprises two or more mutations in a residue selected from the group consisting of D10, E762, H840, N854, N863, or D986. In a further embodiment the CRISPR enzyme comprises two or more mutations selected from the group comprising D10A, E762A, H840A, N854A, N863A or D986A. As mentioned above, N580, especially N580A, according to SaCas9 protein is used, especially in Sa Cas9. In another embodiment, the functional domain is a transcriptional activation domain, e.g. VP64. In another embodiment, the functional domain is a transcriptional repressor domain, e.g. KRAB domain, SID domain or a SID4X domain. In embodiments of the invention, the one or more heterologous functional domains have one or more activities selected from the group consisting of methylase activity, demethylase activity, transcription activation activity, transcription repression activity, transcription release factor activity, histone modification activity, RNA cleavage activity and nucleic acid binding activity. In further embodiments of the invention the cell is a eukaryotic cell or a mammalian cell or a human cell. In further embodiments, the adaptor protein is selected from the group consisting of MS2, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, PRR1. In another embodiment, the at least one loop of the sgRNA is tetraloop and/or loop2. An aspect of the invention encompasses methods of modifying a genomic locus of interest to change gene expression in a cell by introducing into the cell any of the compositions described herein.

An aspect of the invention is that the above elements are comprised in a single composition or comprised in individual compositions. These compositions may advantageously be applied to a host to elicit a functional effect on the genomic level.

In general, the sgRNA are modified in a manner that provides specific binding sites (e.g. aptamers) for adapter proteins comprising one or more functional domains (e.g. via fusion protein) to bind to. The modified sgRNA are modified such that once the sgRNA forms a CRISPR complex (i.e. CRISPR enzyme binding to sgRNA and target) the adapter proteins bind and, the functional domain on the adapter protein is positioned in a spatial orientation which is advantageous for the attributed function to be effective. For example, if the functional domain is a transcription activator (e.g. VP64 or p65), the transcription activator is placed in a spatial orientation which allows it to affect the transcription of the target. Likewise, a transcription repressor will be advantageously positioned to affect the transcription of the target and a nuclease (e.g. Fok1) will be advantageously positioned to cleave or partially cleave the target.

The skilled person will understand that modifications to the sgRNA which allow for binding of the adapter+functional domain but not proper positioning of the adapter+functional domain (e.g. due to steric hindrance within the three dimensional structure of the CRISPR complex) are modifications which are not intended. The one or more modified sgRNA may be modified at the tetra loop, the stem loop 1, stem loop 2, or stem loop 3, as described herein, preferably at either the tetra loop or stem loop 2, and most preferably at both the tetra loop and stem loop 2.

As explained herein the functional domains may be, for example, one or more domains from the group consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g. light inducible). In some cases it is advantageous that additionally at least one NLS is provided. In some instances, it is advantageous to position the NLS at the N terminus. When more than one functional domain is included, the functional domains may be the same or different.

The sgRNA may be designed to include multiple binding recognition sites (e.g. aptamers) specific to the same or different adapter protein. The sgRNA may be designed to bind to the promoter region −1000−+1 nucleic acids upstream of the transcription start site (i.e. TSS), preferably −200 nucleic acids. This positioning improves functional domains which affect gene activation (e.g. transcription activators) or gene inhibition (e.g. transcription repressors). The modified sgRNA may be one or more modified sgRNAs targeted to one or more target loci (e.g. at least 1 sgRNA, at least 2 sgRNA, at least 5 sgRNA, at least 10 sgRNA, at least 20 sgRNA, at least 30 sg RNA, at least 50 sgRNA) comprised in a composition.

Further, the CRISPR enzyme with diminished nuclease activity is most effective when the nuclease activity is inactivated (e.g. nuclease inactivation of at least 70%, at least 80%, at least 90%, at least 95%, at least 97%, or 100% as compared with the wild type enzyme; or to put in another way, a Cas9 enzyme or CRISPR enzyme having advantageously about 0% of the nuclease activity of the non-mutated or wild type Cas9 enzyme or CRISPR enzyme, or no more than about 3% or about 5% or about 10% of the nuclease activity of the non-mutated or wild type Cas9 enzyme or CRISPR enzyme). This is possible by introducing mutations into the RuvC and HNH nuclease domains of the SpCas9 and orthologs thereof. For example utilizing mutations in a residue selected from the group consisting of D10, E762, H840, N854, N863, or D986 and more preferably introducing one or more of the mutations selected from the group consisting of D10A, E762A, H840A, N854A, N863A or D986A. A preferable pair of mutations is D10A with H840A, more preferable is D10A with N863A of SpCas9 and orthologs thereof. In some embodiments, N580A according to SaCas9 protein, may be used, as discussed herein.

The inactivated CRISPR enzyme may have associated (e.g. via fusion protein) one or more functional domains, like for example as described herein for the modified sgRNA adaptor proteins, including for example, one or more domains from the group consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g. light inducible). Preferred domains are Fok1, VP64, P65, HSF1, MyoD1. In the event that Fok1 is provided, it is advantageous that multiple Fok1 functional domains are provided to allow for a functional dimer and that sgRNAs are designed to provide proper spacing for functional use (Fok1) as specifically described in Tsai et al. Nature Biotechnology, Vol. 32, Number 6, June 2014). The adaptor protein may utilize known linkers to attach such functional domains. In some cases it is advantageous that additionally at least one NLS is provided. In some instances, it is advantageous to position the NLS at the N terminus. When more than one functional domain is included, the functional domains may be the same or different.

In general, the positioning of the one or more functional domain on the inactivated CRISPR enzyme is one which allows for correct spatial orientation for the functional domain to affect the target with the attributed functional effect. For example, if the functional domain is a transcription activator (e.g. VP64 or p65), the transcription activator is placed in a spatial orientation which allows it to affect the transcription of the target. Likewise, a transcription repressor will be advantageously positioned to affect the transcription of the target, and a nuclease (e.g. Fok1) will be advantageously positioned to cleave or partially cleave the target. This may include positions other than the N-/C-terminus of the CRISPR enzyme.

Due to crystal structure experiments, the Applicant has identified that positioning the functional domain in the Rec1 domain, the Rec2 domain, the HNH domain, or the PI domain of the SpCas9 protein or any ortholog corresponding to these domains is advantageous. Positioning of the functional domains to the Rec1 domain or the Rec2 domain, of the SpCas9 protein or any ortholog corresponding to these domains, in some instances may be preferred. Positioning of the functional domains to the Rec1 domain at position 553, Rec1 domain at 575, the Rec2 domain at any position of 175-306 or replacement thereof, the HNH domain at any position of 715-901 or replacement thereof, or the PI domain at position 1153 of the SpCas9 protein or any ortholog corresponding to these domains, in some instances may be preferred. Fok1 functional domain may be attached at the N terminus. When more than one functional domain is included, the functional domains may be the same or different.

The adaptor protein may be any number of proteins that binds to an aptamer or recognition site introduced into the modified sgRNA and which allows proper positioning of one or more functional domains, once the sgRNA has been incorporated into the CRISPR complex, to affect the target with the attributed function. As explained in detail in this application such may be coat proteins, preferably bacteriophage coat proteins. The functional domains associated with such adaptor proteins (e.g. in the form of fusion protein) may include, for example, one or more domains from the group consisting of methylase activity, demethylase activity, transcription activation activity, transcription repression activity, transcription release factor activity, histone modification activity, RNA cleavage activity, DNA cleavage activity, nucleic acid binding activity, and molecular switches (e.g. light inducible). Preferred domains are Fok1, VP64, P65, HSF1, MyoD1. In the event that the functional domain is a transcription activator or transcription repressor it is advantageous that additionally at least an NLS is provided and preferably at the N terminus. When more than one functional domain is included, the functional domains may be the same or different. The adaptor protein may utilize known linkers to attach such functional domains.

Thus, the modified sgRNA, the inactivated CRISPR enzyme (with or without functional domains), and the binding protein with one or more functional domains, may each individually be comprised in a composition and administered to a host individually or collectively. Alternatively, these components may be provided in a single composition for administration to a host. Administration to a host may be performed via viral vectors known to the skilled person or described herein for delivery to a host (e.g. lentiviral vector, adenoviral vector, AAV vector). As explained herein, use of different selection markers (e.g. for lentiviral sgRNA selection) and concentration of sgRNA (e.g. dependent on whether multiple sgRNAs are used) may be advantageous for eliciting an improved effect.

On the basis of this concept, several variations are appropriate to elicit a genomic locus event, including DNA cleavage, gene activation, or gene deactivation. Using the provided compositions, the person skilled in the art can advantageously and specifically target single or multiple loci with the same or different functional domains to elicit one or more genomic locus events. The compositions may be applied in a wide variety of methods for screening in libraries in cells and functional modeling in vivo (e.g. gene activation of lincRNA and identification of function; gain-of-function modeling; loss-of-function modeling; the use the compositions of the invention to establish cell lines and transgenic animals for optimization and screening purposes).

The current invention comprehends the use of the compositions of the current invention to establish and utilize conditional or inducible CRISPR transgenic cell/animals. (See, e.g., Platt et al., Cell (2014), http://dx.doi.org/10.1016/j.cell.2014.09.014, or PCT patent publications cited herein, such as WO 2014/093622 (PCT/US2013/074667), which are not believed prior to the present invention or application). For example, the target cell comprises CRISPR enzyme (e.g. Cas9) conditionally or inducibly (e.g. in the form of Cre dependent constructs) and/or the adapter protein conditionally or inducibly and, on expression of a vector introduced into the target cell, the vector expresses that which induces or gives rise to the condition of CRISPR enzyme (e.g. Cas9) expression and/or adaptor expression in the target cell. By applying the teaching and compositions of the current invention with the known method of creating a CRISPR complex, inducible genomic events affected by functional domains are also an aspect of the current invention. One more example of this is the creation of a CRISPR knock-in/conditional transgenic animal (e.g. mouse comprising e.g. a Lox-Stop-polyA-Lox(LSL) cassette) and subsequent delivery of one or more compositions providing one or more modified sgRNA (e.g. −200 nucleotides to TSS of a target gene of interest for gene activation purposes) as described herein (e.g. modified sgRNA with one or more aptamers recognized by coat proteins, e.g. MS2), one or more adapter proteins as described herein (MS2 binding protein linked to one or more VP64) and means for inducing the conditional animal (e.g. Cre recombinase for rendering Cas9 expression inducible). Alternatively, the adaptor protein may be provided as a conditional or inducible element with a conditional or inducible CRISPR enzyme to provide an effective model for screening purposes, which advantageously only requires minimal design and administration of specific sgRNAs for a broad number of applications.

In some embodiments, the CRISPR enzyme is a Cas9 ortholog of a genus belonging to the group consisting of *Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*, wherein the Cas comprises a helical domain 2 truncation.

In an aspect the invention provides a composition, method or use as herein discussed wherein the helical domain 2 truncation is substituted with one or more sets of flexible glycine-serine (GlyGlyGlySer) (SEQ ID NO: 1) or rigid alpha-helical linkers (Ala(GluAlaAlaAlaLys)Ala) (SEQ ID NO: 2) in groups of 3, 6, 9, or 12 repeats (SEQ ID NOS 3-6, respectively) to replace helical domain 2 for potential structural stabilization and/or aiding of retaining Cas9:sgRNA specificity.

In an aspect the invention provides a composition, method or use as herein discussed wherein the CRISPR enzyme is a Cas such as an SpCas9 or SaCas9.

In an aspect the invention provides a non-naturally occurring CRISPR enzyme wherein the HD2 domain has been truncated. The CRISPR enzyme can be a Cas9, e.g., an Sp Cas9 or an Sa Cas9.

In an aspect the invention provides a CRISPR enzyme wherein the truncation is replacement of the HD2 domain, e.g., wherein the truncation is replacement of the HD2 domain with a linker, such as a flexible linker; for instance, a GlySer linker.

In an aspect the invention provides a chimeric 3-component CRISPR enzyme comprising N' and C' terminal components from a first CRISPR enzyme, and an internal component from a second CRISPR enzyme, the second CRISPR enzyme being an ortholog of the first CRISPR enzyme; for instance, wherein the first and second CRISPR enzymes each comprise a Cas9, such as an Sp Cas9 or an Sa Cas9 or an St Cas9, e.g., St3 Cas9. In some aspects the CRISPR enzyme as discussed herein can comprise an internal component from the first CRISPR enzyme replaced by an internal component from the second CRISPR enzyme, said internal components being the same or different. In an aspect of the invention the second CRISPR enzyme is an Sa CRISPR enzyme or an St CRISPR enzyme or an St3 CRISPR enzyme. The invention envisions a composition, method, system, or use of as herein discussed wherein the CRISPR enzyme is chimeric or truncated as herein discussed.

Accordingly, it is an object of the invention not to encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention. Nothing herein is to be construed as a promise.

These and other embodiments are disclosed or are obvious from and encompassed by, the following Detailed Description.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 2A-F shows an exemplary CRISPR system, a possible mechanism of action, an example adaptation for expression in eukaryotic cells, and results of tests assessing nuclear localization and CRISPR activity. FIG. 2C discloses SEQ ID NOS 225 and 226, respectively, in order of appearance. FIG. 2E discloses SEQ ID NOS 227-229, respectively, in order of appearance. FIG. 2F discloses SEQ ID NOS 230-234, respectively, in order of appearance.

FIG. 3A discloses SEQ ID NOS 235, 228 and 236-246, respectively, in order of appearance. FIG. 3C discloses SEQ ID NO: 235.

FIG. 4A-G show an exemplary vector system and results for its use in directing homologous recombination in eukaryotic cells. FIG. 4E discloses SEQ ID NO: 247. FIG. 4F discloses SEQ ID NOS 248 and 249, respectively, in order of appearance. FIG. 4G discloses SEQ ID NOS 250-254, respectively, in order of appearance.

FIG. 5 provides a table of protospacer sequences (SEQ ID NOS 44, 43, 42, 255-260, 46, 45 and 261-265, respectively, in order of appearance) and summarizes modification efficiency results for protospacer targets designed based on exemplary *S. pyogenes* and *S. thermophilus* CRISPR systems with corresponding PAMs against loci in human and mouse genomes. Cells were transfected with Cas9 and either pre-crRNA/tracrRNA or chimeric RNA, and analyzed 72 hours after transfection. Percent indels are calculated based on Surveyor assay results from indicated cell lines (N=3 for all protospacer targets, errors are S.E.M., N.D. indicates not detectable using the Surveyor assay, and N.T. indicates not tested in this study).

FIG. 6A discloses SEQ ID NOS 266 and 267, respectively, in order of appearance.

FIG. 8A-B shows exemplary bicistronic expression vectors for expression of CRISPR system elements in eukaryotic cells. FIG. 8A discloses SEQ ID NOS 268-270, respectively, in order of appearance. FIG. 8B discloses SEQ ID NOS 271, 380 and 381, respectively, in order of appearance.

FIG. 9A-C shows histograms of distances between adjacent S. pyogenes SF370 locus 1 PAM (NGG) (FIG. 9A) and S. thermophilus LMD9 locus 2 PAM (NNAGAAW) (FIG. 9B) in the human genome; and distances for each PAM by chromosome (Chr) (FIG. 9C).

FIG. 10B discloses SEQ ID NOS 272 and 273, respectively, in order of appearance. FIG. 10C discloses SEQ ID NO: 274.

FIG. 11A-C shows exemplary manipulations of a CRISPR system for targeting of genomic loci in mammalian cells. FIG. 11A discloses SEQ ID NO: 275. FIG. 11B discloses SEQ ID NOS 276-278, respectively, in order of appearance.

FIG. 12A discloses SEQ ID NO: 279.

FIG. 14 discloses SEQ ID NO: 274.

FIG. 15 provides a table of sequences (SEQ ID NOS 282-289, 382-383, and 290-291, respectively, in order of appearance) for primers and probes used for Surveyor, RFLP, genomic sequencing, and Northern blot assays.

FIG. 16A discloses SEQ ID NO: 292.

FIG. 18 discloses SEQ ID NOS 293-371, respectively, in order of appearance.

FIG. 21C discloses SEQ ID NOS 372-374, 372, 375, and 374, respectively, in order of appearance.

FIG. 22A discloses SEQ ID NOS 376-378, respectively, in order of appearance. FIG. 22B discloses SEQ ID NO: 379.

FIG. 23J discloses SEQ ID NO: 384. FIG. 23L discloses SEQ ID NOS 385-386.

FIG. 25B discloses linker sequences as SEQ ID NOS: 3-4, 10, 12, 9-11 and 3-6, respectively, in order of appearance.

FIGS. 26A-B show SpCas9 sgRNAs (SEQ ID NOS 387-425, respectively, in order of appearance) from the crystal structure including those mutated to investigate contribution to activity of specific bases or groups to basses.

FIG. 30A-D shows the overall structure. (A) Domain organization of S. pyogenes Cas9, and schematic of the sgRNA:target DNA complex. (B) Ribbon representation of the Cas9-sgRNA-DNA complex. Disordered linkers are shown as red dotted lines. (C) Surface representation of the Cas9-sgRNA-DNA complex. The active sites of the RuvC (D10A) and HNH (H840A) domains are indicated by dashed yellow circles. (D) Electrostatic surface potential of the Cas9-sgRNA-DNA complex. The HNH domain is omitted for clarity. Molecular graphic images were prepared using CueMol (see website at cuemol.org). Also refer to FIGS. 37 and 38.

FIG. 31A-E shows the REC lobe and PI domain. (A) Structure of the REC lobe. The REC2 domain and Bridge helix are colored dark gray and green, respectively. The REC1 domain is colored gray, with the repeat-interacting and anti-repeat-interacting regions colored pale blue and pink, respectively. The bound sgRNA:DNA is shown as semi-transparent ribbon representation. (B) Schematics indicating positions of SpCas9 truncations in the REC1 and REC2 domains. Bars on the right show indel mutations generated by the truncation mutants, measured by SURVEYOR assay (n=3, error bars show mean±S.E.M., N.D., not detectable). (C) Western blot showing expression of truncation mutants in HEK 293FT cells. (D) Structure of the PI domain. The bound sgRNA is shown as semi-transparent ribbon representation. (E) Schematics showing wild-type SpCas9 and St3Cas9, chimeric Cas9, as well as SpCas9 PI domain truncation constructs. Cas9s are assayed for indel generation at target sites upstream of either NGG (left bar graph) or NGGNG (right bar graph) PAMs (n=3, error bars show mean±S.E.M., N.D., not detectable). See also FIGS. 39-41. FIG. 31E discloses SEQ ID NOS 426 and 145, respectively, in order of appearance.

FIG. 33A discloses SEQ ID NO: 428. FIG. 33D discloses SEQ ID NOS 429-442, respectively, in order of appearance.

FIG. 34A-K shows Recognition of the sgRNA:DNA. (A) Schematic of sgRNA:DNA recognition by Cas9. Residues that interact with the sgRNA:DNA via their main chain are shown in parentheses. (B and C-K) Recognition of the guide (B), guide:DNA duplex (D), repeat (E), anti-repeat (F), three-way junction (G), stem loop 1 (H), linker (I), stem loop 2 (J) and stem loop 3 (K). Hydrogen bonds and salt bridges are shown as dashed lines. (C) Effect of Cas9 (top) and sgRNA (bottom) mutations on ability to induce indels (n=3, error bars show mean±S.E.M., p values based on unpaired Student's t-test. N.D., not detectable). FIG. 34A discloses SEQ ID NOS 385 and 443.

FIG. 35A-D shows Structural flexibility of the complex. (A) Structural comparison of Mol A and Mol B. In Mol A (left), disordered linker between the RuvC and HNH domain is indicated by a dotted line. In Mol B (right), the disordered HNH domain is shown as a dashed circle. The flexible connecting segment (α40 and α41) in the RuvC domain is highlighted in orange. (B) Superimposition of the Cas9 proteins in Mol A and Mol B. The two complexes are superimposed based on the core β-sheet of their RuvC domains. The HNH domain and bound sgRNA:DNA are omitted for clarity. (C) Superimposition of the bound sgRNA:DNA in Mol A and Mol B. After superimposition of the two complexes as in (B), the Cas9 proteins are omitted to show the sgRNA:DNA. (D) Molecular surface of Cas9. The HNH domain and bound sgRNA:DNA complex are omitted for clarity. Note that there is no direct contact between the REC and NUC lobes, expect for the interactions between the α2-α3 loop and β17-β18 loop.

FIG. 38A-C shows Di-cysteine mutant (C80L/C574E) is functional in HEK 293FT cells. (A) Schematic illustrating positions of cysteine mutations (C80L and C574E) in Cas9. (B) Sequence of the target site (SEQ ID NO: 444) used to test the function of the C80L/C574E mutant of Cas9. (C) SURVEYOR nuclease assay showing indels generated by either the wild-type or C80L/C574E mutant (n=3).

FIG. 40A-B shows the sequence alignment of Cas9 orthologs in families II-A and II-C(SEQ ID NOS 445-450, respectively in order of appearance). The catalytic residues are shown in red triangles. Critical arginine residues on Bridge helix are shown in green triangles. The secondary structure of *S. pyogenes* Cas9 is shown above the sequences. The figure was prepared using TCoffee (Notredame et al., 2000) and ESPript (Gouet et al., 1999). Sp, *S. pyogenes*; Sm, *Streptococcus mutans*; St3, *Streptococcus thermophilus* CRISPR-3; St1, *Streptococcus thermophilus* CRISPR-1; Cj, *Campylobacter jejuni*; Mm; *Neisseria meningitidis*.

FIG. 64A-F shows structure-guided design and optimization of an RNA-guided transcription activation complex. a, The crystal structure of the Cas9-sgRNA-target DNA tertiary complex (PDB ID: 4OO8) reveals the occlusion of N- and C-terminal fusion sites from the target DNA. The sgRNA tetraloop and stem loop 2 largely do not contact Cas9 amino acid residues in this conformation and can be modified without altering existing Cas9-sgRNA interactions. b, Diagram of three-component transcriptional activation system (SAM): sgRNA2.0, the MS2-p65-HSF1 transcription transactivator, and the dCas9-VP64 fusion protein. MS2 stem-loop additions on the sgRNA are highlighted in red. c, Design and optimization of sgRNA scaffolds for optimal recruitment of MS2-VP64 transactivators. d, MS2 stem-loop placement within the sgRNA significantly affects transcription activation efficiency. e, Combinations of different activation domains act in synergy to further enhance the level of transcription activation. f, Addition of the HSF1 transactivation domain to MS2-p65 further increases the efficiency of transcription activation. All values are mean+−SEM with n=3. * indicate p<0.05 based on Student's t-test.

FIG. 65A-D shows characterization of SAM-mediated gene activation and selection rules for efficient sgRNAs. a, Fold activation of 12 different genes plotted against the location of the sgRNA. Distances are measured in by relative to the TSS at +1. sgRNA1.0 with dCas9-VP64 (grey), sgRNA2.0 with dCas9-VP64 and MS2-p65-HSF1 (blue). Arrows indicate sgRNA target sites with poor transcription activation. All values are mean±SEM with n=3. b, Comparison of activation efficiency achieved using dCas9-VP64 and a single sgRNA1.0 for the target gene; dCas9-VP64, a single sgRNA2.0 for the same target site as the single sgRNA1.0, and MS2-p65-HSF1; and dCas9-VP64 and a mixture of 8 sgRNAs targeting the same gene. c, Efficiency of target gene transcription activation as a function of their baseline expression levels. Genes with a higher basal level of transcription exhibit a lower fold up-regulation. For each target gene, the baseline expression level is measured using qPCR in the GFP-transfected control cells and expressed as level relative to GAPDH (fold lower expression compared to GAPDH on x-axis). d, Correlation of gene activation efficiency with sgRNA targeting position in the proximal promoter region expressed as distance to the TSS. Activation efficiencies of each sgRNA for the same target gene is normalized against the highest-activating sgRNA. Proximity to the TSS is positively correlated with target up-regulation. Blue lines indicate median values, boxes indicate 25th and 75th percentiles.

FIG. 67A-E shows simultaneous activation of endogenous genes using multiplexed sgRNA2.0 expression. a, Activation of individual genes by single sgRNA2.0s with dCas9-VP64 and MS2-p65-HSF1. b, Simultaneous activation of ten genes using a mixture of ten sgRNA2.0s each targeting a different gene. c, The relative efficiency of activation of individual sgRNA2.0 varies depending on the target gene and the number of different-gene targeting sgRNA2.0s. d, Effect of sgRNA dilution on gene activation efficiency. Results are plotted as percentage of activation relative to the fold activation of a single undiluted sgRNA2.0 against the target gene. e, Correlation plot between the activation efficiency of a single 10-fold diluted sgRNA2.0 and the activation efficiency of the same sgRNA2.0 delivered within a mixture of ten different-gene targeting sgRNA2.0s. Performance during sgRNA dilution is significantly predictive of performance in multiplexing, suggesting a guide-autonomous component of multiplexing behaviour. All values are mean+−SEM with n=3.

FIG. 68A-E shows genome-scale lentiviral screen in mammalian cells using SAM. a, Design of three lentiviral vectors for expressing sgRNA2.0, dCas9-VP64, and MS2-p65-HSF1. Each vector contains a distinct selection marker to enable co-selection of cells expressing all three vectors. b, Lentiviral delivery of SAM components was tested by first generating 293FT cell lines stably integrated with dCas9-VP64 and MS2-p65-HSF1, and subsequently transducing these cells with single-gene targeting lentiviral sgRNA2.0s at MOI<0.2. Transcription activation efficiency is measured 4 days post sgRNA2.0s lentivirus transduction and selection with Zeocin or Puromycin. All values are mean+−SEM with n=3. c, Flow chart of transcription activation screening using SAM. d, Cumulative frequency of sgRNA2.0s 3 and 21 days after transduction in A375 cells. Shift in the 21-day curve represents the depletion in a subset of sgRNA2.0s. Less than 0.1% of all guides are not detected at day 3 (detected by less than 10 reads). e, Gene categories showing significant depletion based on Ingenuity Pathway Analysis (p<0.01 after B-H FDR correction). Categories on the left are based on the 1000 most depleted guides and categories on the right are based on the 1000 genes with the highest depletion based on the average of all 3 guides/gene.

FIG. 70A discloses SEQ ID NOS 451-452, 16 and 453, respectively, in order of appearance. FIG. 70B discloses SEQ ID NO: 454. FIG. 70D discloses SEQ ID NOS 455-458, 455 and 459-460, respectively, in order of appearance. FIG. 70E discloses SEQ ID NOS 455-456, 455 and 461-464, respectively, in order of appearance.

FIG. 76A-D shows genome-scale lentiviral screen using Puromycin-resistant SAM sgRNA2.0 library. a, Cumulative frequency of sgRNA2.0s 3 and 21 days after transduction of A375 cells with Puromycin-resistant sgRNA2.0 lentivirus. Shift in the 21-day curve represents the depletion of a subset of sgRNA2.0s. b, Box plot showing the distribution of sgRNA2.0 frequencies at different time points post lentiviral transduction with the Puromycin library, after treatment with DMSO vehicle or PLX-4720. Two infection replicates are shown. c, Identification of top candidate genes using the RIGER P value analysis (KS method) based on the average of both infection replicates. Genes are organized by positions within chromosomes. d, Overlap between the top 20 hits from the Zeo and Puro screens. Genes belonging to the same family are indicated by the same color. There is a 50% overlap between the top hits of each screen as shown at the intersection of the Venn diagram.

FIG. 79A-D shows correlation between sgRNA sequence content and level of depletion in significantly depleted genes. Heat maps of sgRNA nucleotide content versus depletion after 21 days. sgRNA targeting significantly depleted genes (from RIGER analysis) in sgRNA-zeo (a, b) or sgRNA-puro (c, d) screens were analyzed for trends with G content (a, c) or T content (b, d) in the sgRNA sequence. sgRNA depletion is positively correlated with G content and negatively correlated with T content. Other bases analyzed (A and C) had significant (p<0.0007) but weak (r<0.2) negative correlation.

FIG. 80A-EE shows exemplary supplementary sequences of Example 20. FIGS. 80A-80EE disclose SEQ ID NOS 150, 147-149, 151, 465-467, 167, 465-466, 468-469, 465-466, 468, 470-471, 465-466, 468, 472-474, 466-467, 476, 474, 466, 468, 476-479, 466-467, 480-483, 465-466, 468, 470, 480, 484-490, 486-487 and 491-492, respectively, in order of appearance.

FIG. 81A-E shows exemplary target guide sequences used in Example 20. FIGS. 81A-81E disclose SEQ ID NOS 493, 152-153 and 494-636, respectively, in order of appearance.

FIG. 82A-I shows top 300 depleted genes for A375 in Example 20. Mean depletion for each gene is given as the log 2 ratio of Day 21 vs. Day 3 averaged over all sg RNAs for the gene.

FIG. 83A-C shows top 100 genes from the output of the RIGER algorithm for the sgRNA-Zeo PLX screen comparing PLX (mean of the two replicates at Day 21) to DMSO control (mean of the two replicates at Day 21) in Example 20. The Kolmogorov-Smirnov method was used to score genes.

FIG. 84A-C shows top 100 genes from the output of the RIGER algorithm for the sgRNA-Puro PLX screen comparing PLX (mean of the two replicates at Day 21) to DMSO control (mean of the two replicates at Day 21) in Example 20. The Kolmogorov-Smirnov method was used to score genes.

FIG. 85 shows TaqMan qPCR probe ID's used to quantify relative RNA expression levels for each gene (Life Technologies).

The figures herein are for illustrative purposes only and are not necessarily drawn to scale.

DETAILED DESCRIPTION OF THE INVENTION

In particular, Applicants have found that the MS2-binding loop ggccAACATGAGGATCACCCATGTCTGCAGggcc (SEQ ID NO: 8) may replace nucleotides +13 to +16 and nucleotides+53 to +56 of the standard sgRNA backbone. The resulting structure is an sgRNA scaffold in which the tetraloop and stemloop 2 sequences have been replaced by an MS2 binding loop. Without being bound by theory, the tetraloop and stemloop 2 were selected for replacement based on information obtained from the Cas9/RNA/DNA crystal structure. Specifically, the tetraloop and stemloop 2 were found to protrude from the Cas9 protein in such a way which suggested that adding an MS2 binding loop would not interfere with any Cas9 residues. Additionally, the proximity of the tetraloop and stemloop 2 sites to the DNA suggested that localization to these locations would result in a high degree of interaction between the DNA and any recruited protein, such as a transcriptional activator.

In some embodiments, the guide is modified such that nucleotides corresponding to +13 to +16 and/or nucleotides corresponding to +53 to +56 of the standard sgRNA backbone are replaced by the distinct RNA.

In some embodiments, the adaptor protein is an RNA-binding protein. The RNA-binding protein recognises corresponding distinct RNA sequences, which may be aptamers. For example, the MS2 RNA-binding protein recognises and binds specifically to the MS2 aptamer (or visa versa).

In some embodiments, the repression domain(s) for the guide and/or the CRISPR enzyme may be those show in Example 15 to act as follows:
  SID4X domain, which represses transcriptional activity;
  KRAB domain, which represses transcriptional activity;
  the NUE domain, which increases repressive histone methylation; and
  the NcoR domain, which recruits histone deacetylases leading to repressive histone modifications.

Exemplary sequences for repressor domains are to be found in Example 15.

Figure 48:
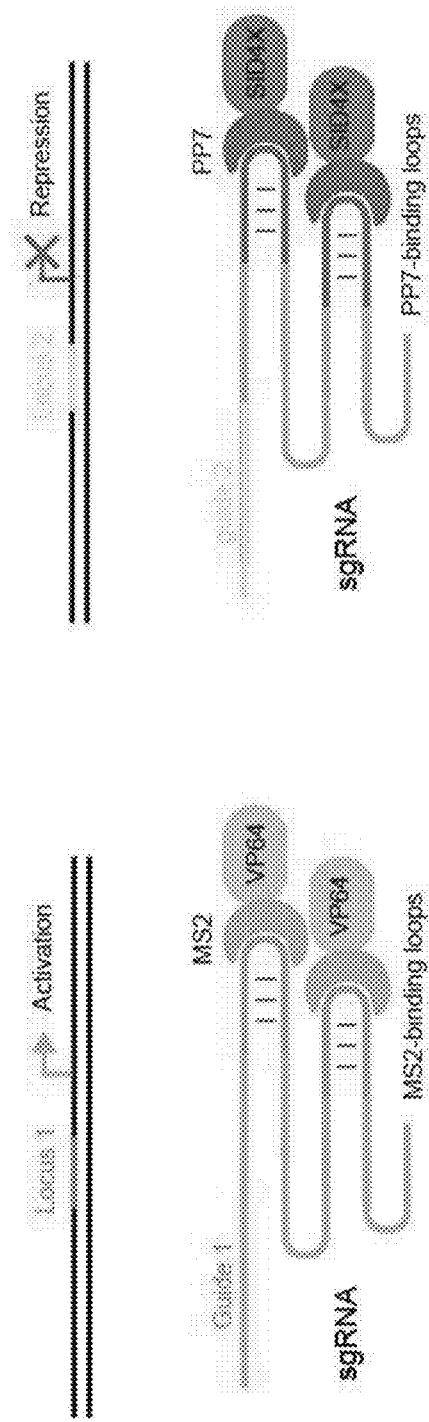
FIG. 48 shows an illustration of orthogonal PP7/MS2 gene targeting. In the schematic, sgRNA targeting different loci are modified with distinct RNA loops in order to recruit MS2-VP64 or PP7-SID4X, which activate and repress their target loci, respectively.

Example 15 also shows an orthogonal approach, see particularly FIG. 48. One guide with a first aptamer/RNA-binding protein pair can be linked or fused to an activator, whilst a second guide with a second aptamer/RNA-binding protein pair can be linked or fused to a repressor. The guides are for different targets (loci), so this allows one gene to be activated and one repressed. For example, the following schematic shows such an approach:
  Guide 1—MS2 aptamer MS2 RNA-binding protein VP64 activator; and
  Guide 2—PP7 aptamer PP7 RNA-binding protein SID4x repressor.

FIG. 48 is an illustration of orthogonal PP7/MS2 gene targeting. In this example, sgRNA targeting different loci are modified with distinct RNA loops in order to recruit MS2-VP64 or PP7-SID4X, which activate and repress their target loci, respectively. PP7 is the RNA-binding coat protein of the bacteriophage *Pseudomonas*. Like MS2, it binds a specific RNA sequence and secondary structure. The PP7 RNA-recognition motif is distinct from that of MS2. Consequently, PP7 and MS2 can be multiplexed to mediate distinct effects at different genomic loci simultaneously. For example, an sgRNA targeting locus A can be modified with MS2 loops, recruiting MS2-VP64 activators, while another sgRNA targeting locus B can be modified with PP7 loops, recruiting PP7-SID4X repressor domains. In the same cell, dCas9 can thus mediate orthogonal, locus-specific modifications. This principle can be extended to incorporate other orthogonal RNA-binding proteins such as Q-beta.

The use of two different aptamers (distinct RNA) allows an activator-adaptor protein fusion and a repressor-adaptor protein fusion to be used, with different guides, to activate expression of one gene, whilst repressing another. They, along with their different guides can be administered together, or substantially together, in a multiplexed approach. A large number of such modified guides can be used all at the same time, for example 10 or 20 or 30 and so forth, whilst only one (or at least a minimal number) of Cas9s to be delivered, as a comparatively small number of Cas9s can be used with a large number modified guides. The adaptor protein may be associated (preferably linked or fused to) one or more activators or one or more repressors. For example, the adaptor protein may be associated with a first activator and a second activator. The first and second activators may be the same, but they are preferably different activators. For example, one might be VP64, whilst the other might be p65, although these are just examples and other transcriptional activators are envisaged. Three or more or even four or more activators (or repressors) may be used, but package size may limit the number being higher than 5 different functional domains. Linkers are preferably used, over a direct fusion to the adaptor protein, where two or more functional domains are associated with the adaptor protein. Suitable linkers might include the GlySer linker.

It is also envisaged that the enzyme-guide complex as a whole may be associated with two or more functional domains. For example, there may be two or more functional domains associated with the enzyme, or there may be two or more functional domains associated with the guide (via one or more adaptor proteins), or there may be one or more functional domains associated with the enzyme and one or more functional domains associated with the guide (via one or more adaptor proteins).

The fusion between the adaptor protein and the activator or repressor may include a linker. For example, GlySer linkers GGGS (SEQ ID NO: 1) can be used. They can be used in repeats of 3 ((GGGGS)$_3$) or 6, 9 or even 12 (SEQ ID NOS 9-12, respectively) or more, to provide suitable lengths, as required. Linkers can be used between the RNA-binding protein and the functional domain (activator or repressor), or between the CRISPR Enzyme (Cas9) and the functional domain (activator or repressor). The linkers the user to engineer appropriate amounts of "mechanical flexibility";

In some embodiments, use of an NLS is envisaged. Applicants found that the NLS from SV40 was helpful in this regard, especially when using lentiviral delivery methods.

A PP7 variant may be used in some embodiments. For example, Applicants found that the PP7 *Pseudomonas* bacteriophage coat protein (with amino acids 68-69 mutated to SG and amino acids 70-75 deleted from the wild type protein as described in Wu, Bin, Jeffrey A. Chao, and Robert H. Singer. "Fluorescence fluctuation spectroscopy enables quantitative imaging of single mRNAs in living cells." *Biophysical journal* 102.12 (2012): 2936-2944. and Chao, Jeffrey A., et al. "Structural basis for the coevolution of a viral RNA-protein complex," *Nature structural & molecular biology* 15.1 (2007): 103-105.), worked well. As such, in some embodiments, where the adaptor protein is an RNA-binding protein and that RNA-binding protein is PP7, the PP7 may be the variant described above, i.e. with amino acids 68-69 mutated to SG and/or amino acids 70-75 deleted from the wild type protein.

Similarly, an MS2 variant may also be used, such as the N55 mutant, especially the N55K mutant. This is the N55K mutant of the MS2 bacteriophage coat protein (shown to have higher binding affinity than wild type MS2 in Lim, F., M. Spingola, and D. S. Peabody. "Altering the RNA binding specificity of a translational repressor." Journal of Biological Chemistry 269.12 (1994): 9006-9010.), and was shown to work in Example 14

Figure 43:
FIG. 43 shows DNA construct design of the previously studied dCas9 activator design. An activation domain is fused to the C-term of a catalytically inactive dCas via a linker. An NLS is incorporated between Cas9 and VP64.

Applicants have shown in Example 13 that both insertions in the tetraloop and loop 2 are effective. In this particular example, the most efficient combination uses an insertion of aptamers (in this case MS2 loops, but we later show that other aptamers may be used as well) in both in the tetraloop and in loop 2 of the sgRNA. We also show that this may be used in combination with a dCas9-vp64 and MS2-vp64 construct, in other words where the CRISPR enzyme is also modified. This new activator design (illustrated in FIG. 44 and shown as red bar for the TL+L2: Ms2 guide in FIG. 45) was found to mediate much higher target gene upregulation compared to the previous design (illustrated in FIG. 43 and shown as the green bar for the regular guide in FIG. 45).

It is also envisaged that other activators may be used. For instance, Example 14, showed that an improved Cas9 activator architecture consists of a sgRNA with MS2 loop insertions in the tetraloop and loop 2 in combination with either MS2-VP64 and dCas9-P65 or MS2-P65 and dCas9-VP64. In other words, 2 different activators can be used, one associated with the CRISPR enzyme (Cas9) and one with the guide via the aptamer. Applicants showed increased effectiveness of this design compared to the standard C-terminal fusion of VP64 to Cas9. Applicants further confirmed the hypothesis that a combination of two different activation domains could improve target gene activation (via synergy, e.g. by recruiting different epigenetic modulators, general transcription factors and co-activators). Applicants also determined that the alternative guide architecture optimized for CRISPR/Cas9 imaging in: Chen, Baohui, et al. "Dynamic Imaging of Genomic Loci in Living Human Cells by an Optimized CRISPR/Cas System." Cell 155.7 (2013): 1479-1491 did not exhibit any improvement over the standard architecture.

Of course, it is envisaged that the activators in these instances may be replaced with repressors.

Applicants also looked at the arrangement of the distinct RNA sequences (preferably aptamers) within the stem loop 2 and tetraloop of the modified guides of the present invention. Example 14 further looks at the use of GC tracts. These are preferred in some embodiments. The GC tract may be GC or GGGGC or CCCCG or CGCC or compliments thereof or a mixture of C and G from 2 nucleotides up to, for example 10, 15 or 20 nucleotides. In the particular instance, the MS2-binding loop sequence:

```
                                         (SEQ ID NO: 8)
       ggccAACATGAGGATCACCCATGTCTGCAGggcc
``` replaced nucleotides+13 to +16 of the standard sgRNA backbone, as above. Of interest here, the sequence CGCC replaced nucleotides+49 to +52 of the standard sgRNA backbone. The sequence GGCG also replaced nucleotides+57 to +60 of the standard sgRNA backbone. The tetraloop MS2-binding loop insertion was designed with the same rationale as described herein. Essentially, CGCC and GGCG sequences replace the stem portion of stemloop 2. The increased base-pairing strength of the CGCC-GGCG stem compared to the original ACTT-AAGT stem was hypothesized to provide additional stability to the stemloop 2 structure, thereby increasing sgRNA performance or longevity.

Accordingly, in some embodiments, one or more GC tracts may replace stem portion of stemloop 2. In some embodiments, one or more GC tracts may replace stem portion of the tetraloop.

When reference is made to the stemloop 2 or tetraloop being modified (including replaced) by distinct RNA sequence(s) then this preferably encompasses modification (or replacement) of the 3 or 4 nucleotides of the guide that were found to protrude beyond the enzyme-sgRNA-DNA complex. Suitable numbering will be apparent based on the secondary structure of the guide on its own, i.e. by looking for the loops corresponding to the stem loop 2 and the tetraloop (or by engineering them in), but exemplary number is around +13-16 and/or either side of +49-52 (with one or two nucleotides leeway either side possible, such as +48-52, or +49 to 53 for example).

A particularly preferred arrangement is to have the aptamer followed by a GGGS linker (SEQ ID NO: 1), preferably (GGGS)$_3$ (SEQ ID NO: 13), together with an NLS, preferably that from SV40.

Applicants, in Example 16, generated a dCas9-based light-inducible MS2-effector, characterized by an MS2-CIB1 recruitment component bound to dCas9-sgRNA, and a CRY2-VP64 transcriptional activator domain. Upon activation with blue light, CRY2-VP64 associate with MS2-CIB1, enabling the recruitment of the transcriptional machinery to the target locus.

Thus, in some embodiments, the adaptor protein may be fused to (or otherwise associated with) a first inducible element, whilst the functional domain may be fused (or otherwise associated) to a second and complimentary inducible element. The complementarity may be provided by heterodimeric binding partners. A preferred example of first and second complementary inducible elements is the CIB1 and CRY2 system. The CIB1 domain is a heterodimeric binding partner of the light-sensitive Cryptochrome 2 (CRY2).

In Example 17 Applicants replaced dCas9 Rec2 domain with a transcriptional effector domain; replace dCas9 HNH domain with a transcriptional effector domain; inserted a transcriptional effector domain at sites of flexible linkers within dCas9 (amino acid 553, 575, or 1153); and created catalytically inactive dCas9 by combination of D10A and N863A mutations, rather than D10A and H840A mutations. Any of these are preferred in certain distinct embodiments.

In some embodiments, Rec2 may be modified, preferably where amino acids 175-306 of dCas9 were replaced with one of the following inserts, with subdomains listed from N- to C-terminus:
VP64 activation domain
3X GGGGS linker (SEQ ID NO: 9), VP64 activation domain, 3X GGGGS linker (SEQ ID NO: 9)
p65 activation domain
3X GGGGS linker (SEQ ID NO: 9), p65 activation domain, 3X GGGGS linker (SEQ ID NO: 9)

In some embodiments, HNH may be modified. For example, in Applicants replaced AA775-901 (of the HNH domain). This may be with either an activator, such as vp64 or P65, or a repressor. The activator or repressor may be flanked by a (GGGGS)3 (SEQ ID NO: 9) or a (GGGGS)6 linker (SEQ ID NO: 10) on both sides of the inserted transcriptional effector domain.

Figure 49:
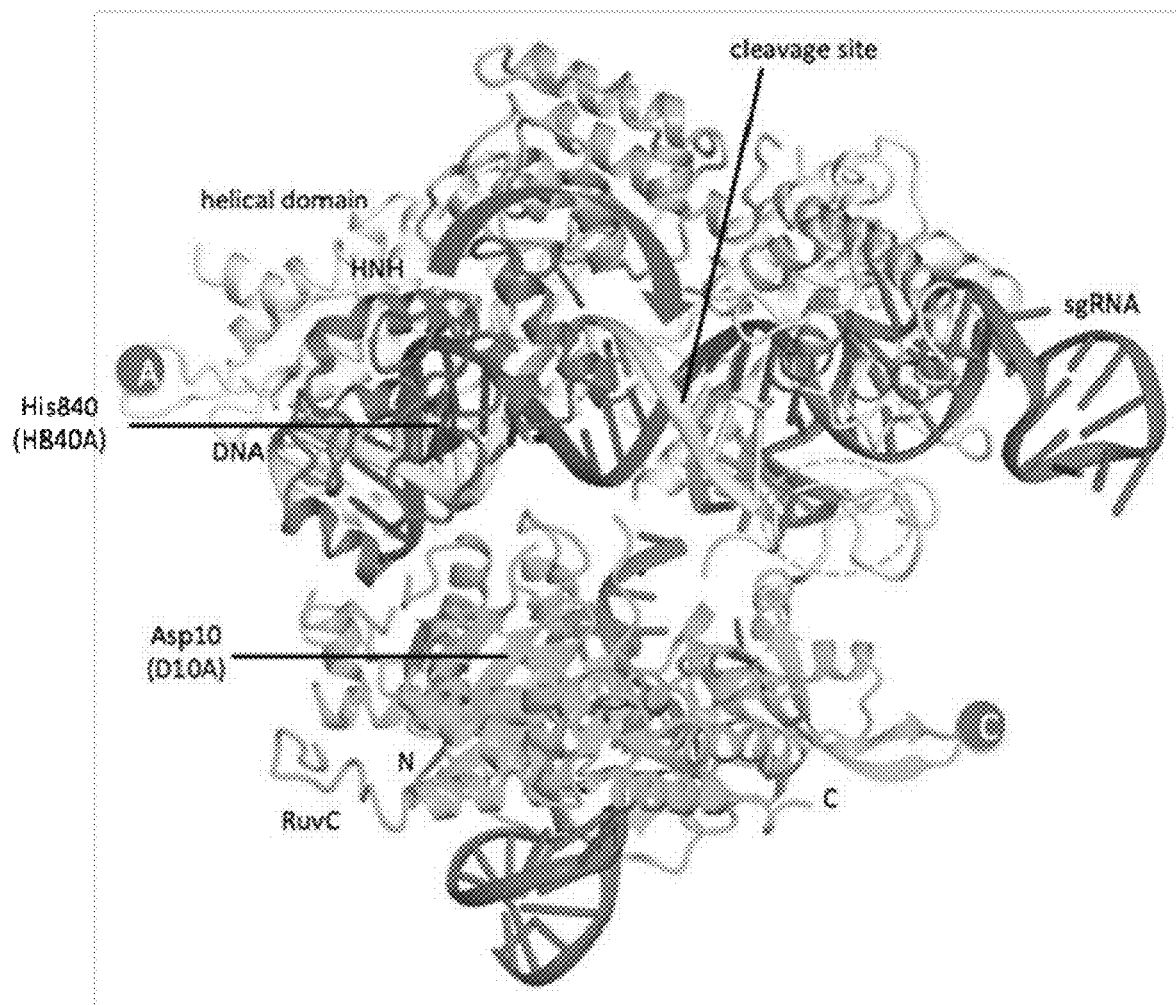
FIG. 49 shows the positions of transcriptional domain replacements and insertions in Cas9. The HNH domain is colored pink. The curved arrow indicates the movement of the HNH domain relative to the DNA (yellow) RNA (blue) duplex due to a conformational change. The A in a red circle indicates the first loop (AA G533) used for insertion of a transcriptional effector domain and its position relative to the target DNA. The third loop (K1153) for insertion of a transcriptional effector domain is indicated by a C on a red circle.

Insertions of transcriptional domains into 3 loops of dCas9 are also envisaged. In addition to replacing an existing domain (e.g. HNH, Rec2) with a transcriptional effector domain, it may be useful, in some embodiments, to insert a transcriptional effector domain at different positions in the Cas9 protein. Applicants identified three favorable positions: G533, F575 and K1153. The locations of G533 and K1153 in the Cas9 protein is indicated in the corresponding FIG. 49. Applicants insert either vp64 or P65 flanked by a (GGGGS)1 (SEQ ID NO: 14) or a (GGGGS)3 (SEQ ID NO: 9) linker on both sides of the inserted transcriptional effector domain at these three locations. As such, in some embodiments, the Cas9 may be modified by insertion of one or more functional domains at any one or more of position corresponding to G533, F575 and K1153 according to SpCas9.

In some embodiments, novel dCas9 mutants are provided. Catalytically inactive dCas9 may be generated by combination of D10A and N863A mutations, rather than D10A and H840A mutations, as shown in Example 18. This numbering refers to Sp Cas9, so corresponding positions in orthologs are envisaged. We also provide N580A as a preferred alternative in Sa Cas9, especially in combination with D10.

As shown in Example 19, N863, especially N863A, referring to Sp Cas9, is also useful in a dead Cas9 and is preferred in some embodiments.

Figure 56:
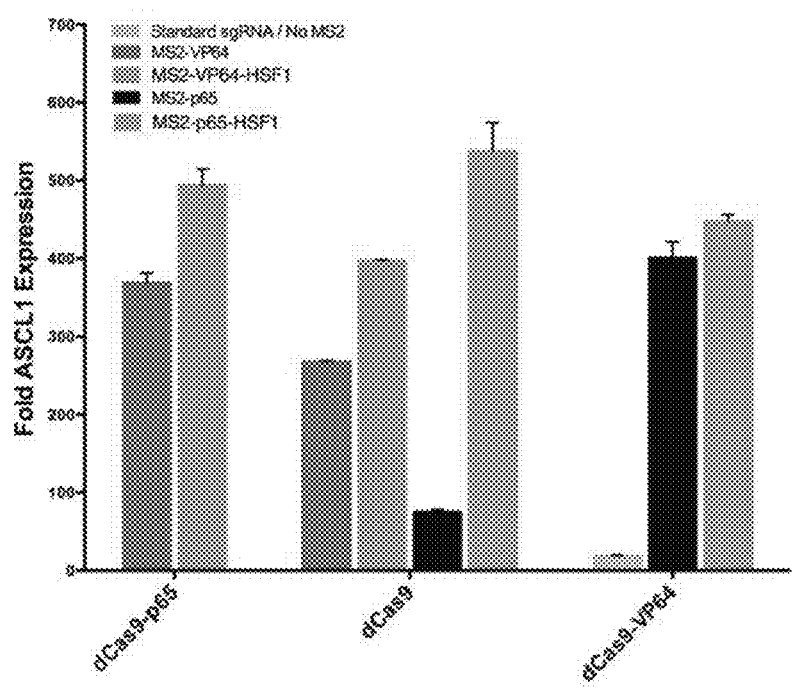
FIG. 56 shows MS2 double activator fusion proteins for ASCL1 activation. Comparisons of MS2-VP64 and MS2-p65 with and without an additional HSF1 activation domain fusion. The greatest relative improvement occurred for dCas9 without its own activation domain. This improvement is particularly important for the future use of the system in multimodal transcriptional modulation, wherein transcriptional modulation occurs only by way of the sgRNA and its aptamerized proteins, not the dCas9, allowing distinct guide sequences to target distinct functionalities.
Figure 57:
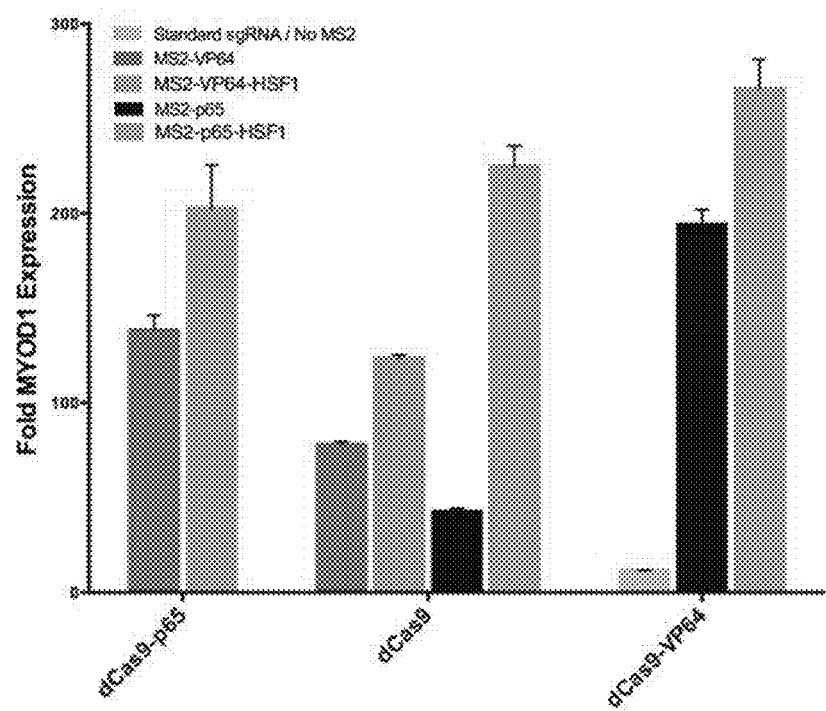
FIG. 57 shows MS2 double activator fusion proteins for MYOD1 activation.

This Example also showed that a combination of different activator domains had an improved effect. For example the construct with a p65-HSF1 fusion was found to be a more potent activator than the construct with p65 alone (FIGS. 56 and 57). Thus, fusions of two or more activators are preferred in some embodiments. Fusions of two or more repressors are also preferred in some embodiments. The activators or repressors may be in any combination of those known in the art and in particular those especially reference herein.

Of particular note was the use in this Example of an orthogonal system, a combined approach using one activator and one repressor. Different guides and different RNA/adaptor protein pairs allowed for activation at one locus and repression at another locus.

Applicants observed significant activation for each of a number purportedly difficult gene targets. Additionally, Applicants observed that the success rate of guide sequences typically increased with closer proximity to the transcriptional start site (TSS) of the target gene. In a preferred embodiment of the invention, for particular targets, within 200 bp of the TSS is deemed to be an advantageous window to select guide RNAs. This information may also be useful for selection of sgRNA guide sequences.

Multiplexed activation has also been shown in Example 19. One important possible advantage of the ability of Applicants' system to provide robust activation with a single guide would be the capacity to easily activate a panel of genes simultaneously (by co-delivery to multiple guides for these genes), which would be intractable if a large number of guides would be required for activation of each gene alone. In order to test the ability of Applicants' system (NLS-dCAS(D10,H840A)-NLS-VP64 in combination with MS2-NLS-P65-HSF1) to activate multiple genes simultaneously, Applicants co-transfected guides targeting 2, 4, 6, 8 or 10 genes at once. Activation of multiple genes was highly successful, as even for a combination of 10 genes each gene was activated significantly. (see FIGS. 60-63). In some embodiments, therefore, an adaptor protein may advantageously be linked or fused to fused or linked activators, as also discussed above, or repressors. This may then be delivered with multiple guides to different targets. This is therefore especially useful in a screening method where the activation or repression of one or more genes is to be interrogated.

Example 20 is particularly interesting. This focuses on the identification of two 4nt stretches in the guides that are exposed "outside" of Cas9-guide-target DNA complex. One 4nt stretch falls in the tetraloop, the other 4nt stretch falls in the stem loop 2. These 4nt stretches can be replaced by aptamer sequence. The one or more aptamer(s) is a polynucleotide and may be DNA or RNA, but RNA is preferred. The aptamer has a corresponding RNA-binding protein that recognises a specific RNA sequence.

Thus, the MS2 system used here comprises an RNA sequence inserted into the guide (at one or both of the above locations) and a corresponding MS2 (RNA-binding) protein. The RNA-binding protein may then be fused to a functional domain such as an activator or a repressor. Instead of being fused directly to a functional domain, the RNA-binding protein could be fused to a further element such as an antibody that can then bind to and recognise a functional domain or a molecule fused to a functional domain, similar to the heterduplex CIB1-Cry2 system described above. This may allow for greater temporal or spatial control.

In short, a specific RNA sequence may be inserted into the exposed guide loop(s) and a corresponding RNA-binding protein may be used, whether that is fused to a functional domain, or a further element which in turn recognises or binds specifically to a functional domain. The functional domain may be a transacting activator or a repressor.

This can be used in Screening Methods to assess G.O.F (Gain Of Function) and/or L.O.F. (Loss of Function).

Figure 44:
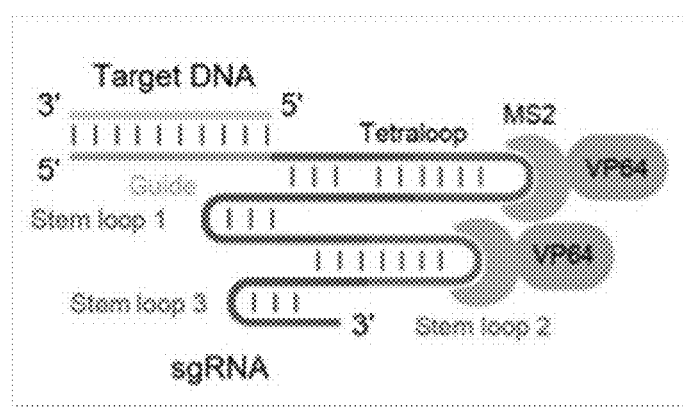
FIG. 44 shows illustration of insertions of MS2 loops in at the end of the Tetraloop and loop 2 of the sgRNA. An MS2-VP64 fusion protein is recruited to these two loops. Together with dCas9 this leads to a recruitment of the VP64 activation domain to the target DNA of the target locus. Inserted MS2 RNA stem loops are colored dark green.
Figure 45:
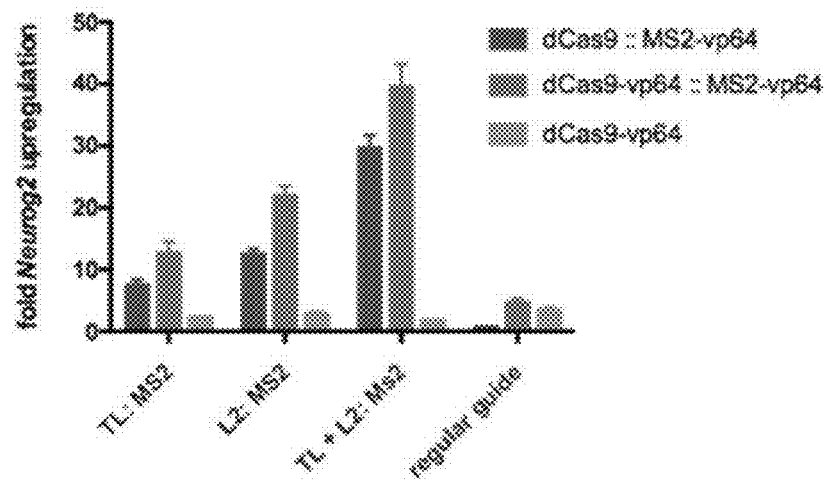
FIG. 45 shows a graphical representation of the upregulation of Neurog2 expression in Neuro2A cells. 4 different guide RNAs including an Ms2 loop inserted in either the tetraloop or loop 2, both loops or none were tested in combination with dCas9 and MS2-vp64, dCas9-vp64 and MS2-vp64 or dCas9-vp64 alone. TL:MS2, MS2 loop insertion into the sgRNA tetraloop; L2: MS2, MS2 loop insertion into loop 2 of the sgRNA. Colors indicate which protein-coding constructs were co-transfected with the corresponding guide.

Identification of the stemloop 2 and the tetraloop has been discussed above, but the skilled person may also want to refer to FIGS. 44, 48, 64 (especially a and b) and 70 for guidance. FIG. 70 shows nucleotide numbering corresponding to the stem loop 2 and the tetraloop. For example, in some embodiments, the tetraloop is or includes nucleotides G29 to A41 of the guide tested and comprises 5'-GCUA-GAAUAGCA-3' (SEQ ID NO: 15) (positions 29-41). Guide nucleotides, such as C40, may preferably interact with Cas9 amino acid Arg340. In some embodiments, stem loop 2 may be or include nucleotides A68 to G81 of the guide used (5'-AACUUGAAAAAGUG-3') (SEQ ID NO: 16). Enzyme amino acids His1349 and Ser1351 may, in some embodiments, interact with guide nucleotides, such as A68. In some embodiments, Lys33 and Tyr1356 may interact with nucleotide G81.

In some embodiments, it is preferable to use complimentary GGCC inserts (GC tracts) flanking the MS insert (the 5'-GGCC-3' being complimentary to the same sequence at the 3' end (and in the opposite orientation i.e. 3'CCGG-5', as shown FIG. 70).

Although single MS2 addition (i.e. to one or other of the tetraloop or stem loop 2) shows an improvement in terms of Gain of Function (gene upregulation) compared to a standard guide, the double addition (MS2 on both loops) shows even stronger upregulation. The use of two or more functional domains with the guide is therefore preferred.

As mentioned herein, having one activator, such as VP64, bound to Cas9 and a separate similar activator, again VP64 in this example, bound to the guide via MS2 shows the greatest improvement in terms of Gain of Function (gene upregulation). Other activators or repressors may be exchanged here for the activator mentioned.

We also show in this Example an improvement in terms of Gain of Function (gene upregulation) compared to a prior art MS-guide RNA arrangement where the MS2 is attached at the 3' end of the guide. This art approach is as opposed to the present loops which are both internal and certainly not 3' terminal or are at least followed (in the 3' direction) by an additional loop (stem loop 3).

LincRNAs (a non-coding RNA produced from bi-directional promoters—the other direction being RNA corresponding to the gene of interest) may also be targeted via the guides and/or interrogated.

This Example also shows that lentivirus based delivery is useful. Overall, the system showed enhanced transcriptional activation. It is thus useful in a genome-wide transcriptional activation or overexpression screening methods. For example, the invention may be used to identify genes whose upregulation causes a certain phenotypic result—in this example, it was resistance to BRAF kinase inhibitor in cancer cells.

Applicants, without being bound by theory, believe that guide direction does not significantly affect activation activity, instead the primary factor influencing activation potency is that the sgRNA site is located within the −200 to +1 bp proximal promoter region. This region is therefore a preferred target for the guide(s).

The adaptor protein (and hence its corresponding distinct RNA (preferably an aptamer) is preferably chosen from within bacteriophage coat proteins. Preferred examples include those already listed elsewhere herein.

Example 21 shows that an inducible structural design activation mediator transgenic model, in this case a mouse, may be established. A repression model may be similarity generated. Preferably, a mouse engineered with the Lox-Stop-polyA-Lox(LSL) cassette upstream to the coding region of the SpCas9-VP64 fusion protein is established. A second mouse may be engineered with the Lox-Stop-polyA-Lox(LSL) cassette upstream to the coding region of the SpCas9-VP64 fusion protein and upstream to the coding region of the MS2-P65-HSF1 fusion protein.

Example 22 investigates targeted lincRNAs of unknown function to determine aberrant phenotypes. It includes an investigation of Gain of Function and Loss of function in human cell lines (using Cre inducibility) and mice through use of guides that target the regulatory regions of these genes, with guides including an activator or a repressor.

When looking at lincRNAs, guides may be designed to target the promoter region. Ideally, this should be within 1000 nucleotides upstream of the TTS of the target, in this case, lincRNAs of unknown function. Animals, such as mice, may then be screened for aberrant phenotypes.

Cells for which the sgRNA has an activator may be monitored for Gain of Function, whilst cells for which the sgRNA has a repressor may be monitored for Loss of Function. In this fashion, mammalian, including mouse and human cells, can be screened.

In an aspect, the vector systems used in the methods of the invention comprise one or more lentiviral vector(s). In a preferred embodiment, the one or more lentiviral vectors may comprise a codon optimized nuclear localization signal (NLS), a codon optimized P2A bicistronic linker sequence and an optimally placed U6 driven guide RNA cassette. In another aspect the vector system comprises two lentiviral vectors, wherein one lentiviral vector comprises the Cas9 enzyme and the other lentiviral vector comprises the guide RNA selected from the libraries of the invention. In an embodiment of the invention, each vector has a different selection marker, e.g. a different antibiotic resistance marker. The invention also comprehends kits comprising the libraries of the invention. In certain aspects, the kit comprises a single container comprising vectors comprising the library of the invention. In other aspects, the kit comprises a single container comprising plasmids comprising the library of the invention. The invention also comprehends kits comprising a panel comprising a selection of unique CRISPR-Cas system guide sequences from the library of the invention, wherein the selection is indicative of a particular physiological condition. In preferred embodiments, the targeting is of about 100 or more sequences, about 1000 or more sequences or about 20,000 or more sequences or the entire genome. In other embodiments a panel of target sequences is focused on a relevant or desirable pathway, such as an immune pathway or cell division.

Accordingly, Examples 21 and 22 show that creation of a non-human animal or cell may be realistically provided. It has preferably been altered, or is a progeny of said altered animal or cell, to constitutively or conditionally express a Cas9 with one or more mutations to modify catalytic activity, as discussed herein. The model may be used for screening with appropriate guides and with different adaptors and activators or repressors as discussed herein for multiplexing to show up and/or down-regulation of target gene function. Thus, corresponding cell lines and transgenic mammalian models are provided. Further guidance on models and cell lines is provided herein.

The exposed or extraneous portion of the guide (when the guide-Cas9-DNA complex is formed) is preferably a 4 (four) nucleotide stretch. In some embodiments, the stretch may be in the tetraloop. In some embodiments, the stretch may be in the stem loop 2. In some embodiments, stretches in both the tetraloop and the stem loop 2 are envisaged.

This stretch may be modified, altered or entirely replaced. It is not generally preferred to reduce the number of nucleotides in the exposed stretch to less than 4 for stearic reasons as this could affect the secondary structure of the rest of the guide and thus affect formation of the Cas9-guide-DNA complex or the exposure of the stretch.

It may be modified or altered in that all four of the original 4 nucleotides in the stretch are retained and additions (or further nucleotides) are made between 1 and 2, 2 and 3, or 3 and 4. It is also envisaged that additions may be made immediately 5' to 1 or 3' immediately to 4. The stem may be flexible, but it is preferred that it is largely self-complementary throughout.

Unafold is a software tool that can be used to help predict RNA secondary structure in the guide and so assist the skilled person in determine what changes to the guide RNA may be acceptable within the framework discussed herein.

Ideally, the loop feature should be retained but protein binding section of the distinct RNA added to the guide will determine this. The non-loop ends abutting the edge of the enzyme should ideally be retained in the sense that they need to be present, but the primary sequence of the original guide can be changed, for example by insertion of one or more GC tract(s). Ideally, this should be done at the non-loop (non-protein-binding end) of the distinct RNA added, which may be extended. The secondary structure of the non-protein-binding region of the distinct RNA should preferably form a stem, as mentioned.

It is preferred to avoid bulges or loops in the exposed section (non-protein-binding section of the distinct RNA, i.e. that between the edge of the enzyme complex and the protein binding domain of the distinct RNA/Aptamer). Rather, it is preferred to retain a stem as secondary structure in the exposed section.

A stem may be formed in the RNA through use of complimentary sections of roughly the same length, with mismatches minimized. The maximum length of the stem (or number of nucleotides forming the stem in both the 5' to 3' and 3' to 5' strands) is preferably 100 nucleotides or so in total (i.e. 2 sections of approx. 50 nucleotides) to reduce stearic effects and reduce possible formation of additional secondary or tertiary structure in the nucleotides. However, 50-60 nucleotides may be a more preferable maximum, but given the general need to keep package size down, 10 to 20 or 30 is most preferable, whilst, 8, 10 or 12 is most preferred.

A preferred minimum length is 4 nucleotides either side of the protein-binding loop.

Also provided are methods of upregulation of gene expression in a target locus comprising administration of the present modified guides directed to the target, where the adaptor protein is associated with an activator. The CRISPR enzyme may also be modified with a functional domain.

Also provided are methods of downregulation of gene expression in a target locus comprising administration of the present modified guides directed to the target, where the adaptor protein is associated with a repressor. The CRISPR enzyme may also be modified with a functional domain.

Such methods may be used in a method of treating a subject in need thereof, for example a subject requiring gene upregulation or gene downregulation, as appropriate. A multiplex method may also be used where one gene is upregulated and another is down regulated for instance by following the orthogonal approach discussed herein.

Also provided is the present compositions and systems for use in such methods of treatment. Use of the present compositions and systems in the manufacture of a medicament for such treatment is also provided.

In relation to the guides in general, but specifically in respect of the present modified sgRNA and the complex formed therewith, it is preferable that the guide has one or more of the following features. In some embodiments, the tracr sequence has one or more hairpins and is 30 or more nucleotides in length, more preferably 40 or more nucleotides in length, or more preferably 50 or more nucleotides in length. In some embodiments, the guide sequence is between 10 to 30 nucleotides in length. In some embodiments, the CRISPR/Cas enzyme is a Type II Cas9 enzyme. In some embodiments, the tracr sequence has one or more hairpins and is 30 or more nucleotides in length, more preferably 40 or more nucleotides in length, or more preferably 50 or more nucleotides in length, the guide sequence is between 10 to 30 nucleotides in length and the CRISPR/Cas enzyme is a Type II Cas9 enzyme.

Endogenous transcriptional repression is often mediated by chromatin modifying enzymes such as histone methyltransferases (HMTs) and deacetylases (HDACs). Repressive histone effector domains are known and an exemplary list is provided below. In the exemplary table, preference was given to proteins and functional truncations of small size to facilitate efficient viral packaging (for instance via AAV). In general, however, the domains may include HDACs, histone methyltransferases (HMTs), and histone acetyltransferase (HAT) inhibitors, as well as HDAC and HMT recruiting proteins. The functional domain may be or include, in some embodiments, HDAC Effector Domains, HDAC Recruiter Effector Domains, Histone Methyltransferase (HMT) Effector Domains, Histone Methyltransferase (HMT) Recruiter Effector Domains, or Histone Acetyltransferase Inhibitor Effector Domains.

| HDAC Effector Domains | | | | | | | | |
|---|---|---|---|---|---|---|---|---|
| Subtype/ Complex | Name | Substrate (if known) | Modification (if known) | Organism | Full size (aa) | Selected truncation (aa) | Final size (aa) | Catalytic domain |
| HDAC I | HDAC8 | — | — | X. laevis | 325 | 1-325 | 325 | 1-272: HDAC |
| HDAC I | RPD3 | — | — | S. cerevisiae | 433 | 19-340 | 322 (Vannier) | 19-331: HDAC |
| HDAC IV | MesoLo4 | — | — | M. loti | 300 | 1-300 (Gregoretti) | 300 | — |
| HDAC IV | HDAC11 | — | — | H. sapiens | 347 | 1-347 (Gao) | 347 | 14-326: HDAC |
| HD2 | HDT1 | — | — | A. thaliana | 245 | 1-211 (Wu) | 211 | — |
| SIRT I | SIRT3 | H3K9Ac H4K16Ac H3K56Ac | — | H. sapiens | 399 | 143-399 (Scher) | 257 | 126-382: SIRT |
| SIRT I | HST2 | — | — | C. albicans | 331 | 1-331 (Hnisz) | 331 | — |
| SIRT I | CobB | — | — | E. coli (K12) | 242 | 1-242 (Landry) | 242 | — |

-continued

| Subtype/Complex | Name | Substrate (if known) | Modification (if known) | Organism | Full size (aa) | Selected truncation (aa) | Final size (aa) | Catalytic domain |
|---|---|---|---|---|---|---|---|---|
| SIRT I | HST2 | — | — | S. cerevisiae | 357 | 8-298 (Wilson) | 291 | — |
| SIRT III | SIRT5 | H4K8Ac H4K16Ac | — | H. sapiens | 310 | 37-310 (Gertz) | 274 | 41-309: SIRT |
| SIRT III | Sir2A | — | — | P. falciparum | 273 | 1-273 (Zhu) | 273 | 19-273: SIRT |
| SIRT IV | SIRT6 | H3K9Ac H3K56Ac | — | H. sapiens | 355 | 1-289 (Tennen) | 289 | 35-274: SIRT |

HDAC Effector Domains

Accordingly, the repressor domains of the present invention may be selected from histone methyltransferases (HMTs), histone deacetylases (HDACs), histone acetyltransferase (HAT) inhibitors, as well as HDAC and HMT recruiting proteins.

The HDAC domain may be any of those in the table above, namely: HDAC8, RPD3, MesoLo4, HDAC11, HDT1, SIRT3, HST2, CobB, HST2, SIRT5, Sir2A, or SIRT6.

In some embodiment, the functional domain may be a HDAC Recruiter Effector Domain. Preferred examples include those in the Table below, namely MeCP2, MBD2b, Sin3a, NcoR, SALL1, RCOR1. NcoR is exemplified in the present Examples and, although preferred, it is envisaged that others in the class will also be useful.

Table of HDAC Recruiter Effector Domains

| Subtype/Complex | Name | Substrate (if known) | Modification (if known) | Organism | Full size (aa) | Selected truncation (aa) | Final size (aa) | Catalytic domain |
|---|---|---|---|---|---|---|---|---|
| Sin3a | MeCP2 | — | — | R. norvegicus | 492 | 207-492 (Nan) | 286 | — |
| Sin3a | MBD2b | — | — | H. sapiens | 262 | 45-262 (Boeke) | 218 | — |
| Sin3a | Sin3a | — | — | H. sapiens | 1273 | 524-851 (Laherty) | 328 | 627-829: HDAC1 interaction |
| NcoR | NcoR | — | — | H. sapiens | 2440 | 420-488 (Zhang) | 69 | — |
| NuRD | SALL1 | — | — | M. musculus | 1322 | 1-93 (Lauberth) | 93 | — |
| CoREST | RCOR1 | — | — | H. sapiens | 482 | 81-300 (Gu, Ouyang) | 220 | — |

In some embodiment, the functional domain may be a Methyltransferase (HMT) Effector Domain. Preferred examples include those in the Table below, namely NUE, vSET, EHMT2/G9A, SUV39H1, dim-5, KYP, SUVR4, SET4, SET1, SETD8, and TgSET8. NUE is exemplified in the present Examples and, although preferred, it is envisaged that others in the class will also be useful.

Table of Histone Methyltransferase (HMT) Effector Domains

| Subtype/Complex | Name | Substrate (if known) | Modification (if known) | Organism | Full size (aa) | Selected truncation (aa) | Final size (aa) | Catalytic domain |
|---|---|---|---|---|---|---|---|---|
| SET | NUE | H2B, H3, H4 | — | C. trachomatis | 219 | 1-219 (Pennini) | 219 | — |
| SET | vSET | — | H3K27me3 | P. bursaria chlorella virus | 119 | 1-119 (Mujtaba) | 119 | 4-112: SET2 |
| SUV39 family | EHMT2/G9A | H1.4K2, H3K9, H3K27 | H3K9me1/2, H1K25me1 | M. musculus | 1263 | 969-1263 (Tachibana) | 295 | 1025-1233: preSET, SET, postSET |
| SUV39 | SUV39H1 | — | H3K9me2/3 | H. sapiens | 412 | 79-412 (Snowden) | 334 | 172-412: preSET, |

Table of Histone Methyltransferase (HMT) Effector Domains

| Subtype/Complex | Name | Substrate (if known) | Modification (if known) | Organism | Full size (aa) | Selected truncation (aa) | Final size (aa) | Catalytic domain |
|---|---|---|---|---|---|---|---|---|
| Suvar3-9 | dim-5 | — | H3K9me3 | N. crassa | 331 | 1-331 (Rathert) | 331 | SET, postSET 77-331: preSET, SET, postSET |
| Suvar3-9 (SUVH subfamily) | KYP | — | H3K9me1/2 | A. thaliana | 624 | 335-601 | 267 (Jackson) | — |
| Suvar3-9 (SUVR subfamily) | SUVR4 | H3K9me1 | H3K9me2/3 | A. thaliana | 492 | 180-492 | 313 (Thorstensen) | 192-462: preSET, SET, postSET |
| Suvar4-20 | SET4 | — | H4K20me3 | C. elegans | 288 | 1-288 (Vielle) | 288 | — |
| SET8 | SET1 | — | H4K20me1 | C. elegans | 242 | 1-242 (Vielle) | 242 | — |
| SET8 | SETD8 | — | H4K20me1 | H. sapiens | 393 | 185-393 | 209 (Couture) | 256-382: SET |
| SET8 | TgSET8 | — | H4K20me1/2/3 | T. gondii | 1893 | 1590-1893 (Sautel) | 304 | 1749-1884: SET |

In some embodiment, the functional domain may be a Histone Methyltransferase (HMT) Recruiter Effector Domain. Preferred examples include those in the Table below, namely Hp1a, PHF19, and NIPP1.

Table of Histone Methyltransferase (HMT) Recruiter Effector Domains ("GGSG" disclosed as SEQ ID NO: 17)

| Subtype/Complex | Name | Substrate (if known) | Modification (if known) | Organism | Full size (aa) | Selected truncation (aa) | Final size (aa) | Catalytic domain |
|---|---|---|---|---|---|---|---|---|
| — | Hp1a | — | H3K9me3 | M. musculus | 191 | 73-191 | 119 (Hathaway) | 121-179: chromoshadow |
| — | PHF19 | — | H3K27me3 | H. sapiens | 580 | (1-250) + GGSG linker + (500-580) | 335 (Ballaré) | 163-250: PHD2 |
| — | NIPP1 | — | H3K27me3 | H. sapiens | 351 | 1-329 (Jin) | 329 | 310-329: EED |

In some embodiment, the functional domain may be Histone Acetyltransferase Inhibitor Effector Domain. Preferred examples include SET/TAF-1β listed in the Table below.

Table of Histone Acetyltransferase Inhibitor Effector Domains

| Subtype/Complex | Name | Substrate (if known) | Modification (if known) | Organism | Full size (aa) | Selected truncation (aa) | Final size (aa) | Catalytic domain |
|---|---|---|---|---|---|---|---|---|
| — | SET/TAF-1β | — | — | M. musculus | 289 | 1-289 (Cervoni) | 289 | — |

It is also preferred to target endogenous (regulatory) control elements (such as enhancers and silencers) in addition to a promoter or promoter-proximal elements. Thus, the invention can also be used to target endogenous control elements (including enhancers and silencers) in addition to targeting of the promoter. These control elements can be located upstream and downstream of the transcriptional start site (TSS), starting from 200 bp from the TSS to 100 kb away. Targeting of known control elements can be used to activate or repress the gene of interest. In some cases, a single control element can influence the transcription of multiple target genes. Targeting of a single control element could therefore be used to control the transcription of multiple genes simultaneously.

Targeting of putative control elements on the other hand (e.g. by tiling the region of the putative control element as well as 200 bp up to 100 kB around the element) can be used as a means to verify such elements (by measuring the transcription of the gene of interest) or to detect novel control elements (e.g. by tiling 100 kb upstream and downstream of the TSS of the gene of interest). In addition, targeting of putative control elements can be useful in the context of understanding genetic causes of disease. Many mutations and common SNP variants associated with disease phenotypes are located outside coding regions. Targeting of such regions with either the activation or repression systems described herein can be followed by readout of transcription of either a) a set of putative targets (e.g. a set of genes located in closest proximity to the control element) or b) whole-transcriptome readout by e.g. RNAseq or microarray. This would allow for the identification of likely candidate genes involved in the disease phenotype. Such candidate genes could be useful as novel drug targets.

The term "associated with" is used here in respect of how one molecule 'associates' with respect to another, for example between an adaptor protein and a functional domain, or between the CRISPR enzyme and a functional domain. In the case of such protein-protein interactions, this association may be viewed in terms of recognition in the way an antibody recognises an epitope. Alternatively, one protein may be associated with another protein via a fusion of the two, for instance one subunit being fused to another subunit. Fusion typically occurs by addition of the amino acid sequence of one to that of the other, for instance via splicing together of the nucleotide sequences that encode each protein or subunit. Alternatively, this may essentially be viewed as binding between two molecules or direct linkage, such as a fusion protein. In any event, the fusion protein may include a linker between the two subunits of interest (i.e. between the enzyme and the functional domain or between the adaptor protein and the functional domain). Thus, in some embodiments, the CRISPR enzyme or adaptor protein is associated with a functional domain by binding thereto. In other embodiments, the CRISPR enzyme or adaptor protein is associated with a functional domain because the two are fused together, optionally via an intermediate linker.

RNA sequences that bind to protein sequences are known, in particular aptamers, but the way in which they bind to, for example, an adaptor protein is that the RNA sequence recognises and forms a complex with a corresponding RNA-binding domain or portion on the protein. This is an analogous situation to the manner in which an antibody recognises an epitope. Thus, in some embodiments, the distinct RNA sequence recognises and binds to a complementary RNA-binding domain or portion on the adaptor protein. In some embodiments, the distinct RNA sequence is an aptamer. The functioning of an aptamer is well-known in the way that is associates with its corresponding protein.

The distinct RNA sequence is a sequence that is different in origin and/or sequence from the guide into which it is inserted. The insertion may include the replacement (deletion) of one or more of the original guide nucleotides at the insertion site. Alternatively, the original guide nucleotides may be retained with the insertion site between them such that the inserted nucleotides separate the previously neighbouring (in terms of primary structure) original nucleotides. The distinct RNA sequence thus may differs in the sense that it has a different primary structure (nucleotide sequence) from the nucleotides that it is replacing. Either way. if replacing or if merely inserting without deletion, the overall primary sequence of the resulting modified guide will change. Thus, in one embodiment. a distinct RNA sequence is one that results in a different sequence (primary structure) in the resulting modified guide.

In some embodiments, the methods provided herein may occur ex vivo unless otherwise apparent.

Applicants have found, both in Example 9 and in Example 24, is that the Helical Domain 2 (HD2) of Sp Cas9 may be deleted. While some activity may be lost, this may only be around 50%; and this truncation may be advantageous. Although relatively small, a modest reduction in the total number of amino acids for Sp Cas9 is seen. This can only help with packaging Cas9 or the coding for Cas9 and guides into a single vector for delivery. In some circumstances a functional but less active Cas9, or relatively active Cas9 is advantageous; for instance if off-target effects are a concern, or when a functional domain is associated with the CRISPR Cas9 complex (e.g., with the Cas9 protein). In place of the portion of Cas9 truncated, Applicants added a linker in Example 9.

Applicants also found, in Example 24, that chimeric three-component enzymes can be created, focusing on the HD2 and surrounding regions of Sp Cas9. To date, work has focused on creating chimeras where the N' or C' terminal domains are swapped out of Sp and replaced with corresponding domains from St Cas9, for example providing [N' terminal Sp Cas9-C' terminal St Cas9] chimeras. These two-component chimeras are useful but Applicants have now found that chimeric 3-component enzymes are possible and functional.

Accordingly, in an aspect, the present invention provides a CRISPR enzyme or Cas enzyme, preferably Cas9, wherein the HD2 domain has been truncated. In some embodiments, the truncation is replacement of the HD2 domain (i.e. in its entirety). In some embodiments, the truncation is replacement of the HD2 domain or truncated portion thereof with a linker, preferably a GlySer or other flexible linker, or a rigid linker such as alpha-helical linkers (Ala(GluAlaAlaAlaLys)Ala) (SEQ ID NO: 2). A suitable example of an HD2 domain (in this instance from Sp Cas9) is provided in Example 9 and examples of truncated sequences lacking said HD2 domain are also provided for guidance.

In some embodiments, the CRISPR enzyme is a Cas9 ortholog of a genus belonging to the group consisting of Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma and Campylobacter, wherein the Cas comprises a helical domain 2 truncation.

In some embodiments, the helical domain 2 truncation is substituted with one or more sets of flexible glycine-serine (GlyGlyGlySer) (SEQ ID NO: 1) or rigid alpha-helical linkers (Ala(GluAlaAlaAlaLys)Ala) in groups of 1, 3, 6, 9, or 12 repeats (SEQ ID NOS 2-6, respectively) to replace helical domain 2. This may provide potential structural stabilization and/or aiding of retaining Cas9: sgRNA specificity.

Accordingly, in another aspect, the present invention provides a chimeric 3-component CRISPR enzyme or Cas enzyme, preferably Cas9. The chimeric 3-component enzyme preferably comprises N' and C' terminal components from a first CRISPR enzyme or Cas enzyme, for example Sp Cas9, and an internal component from a different enzyme, i.e. a second CRISPR enzyme or Cas enzyme. The second CRISPR enzyme or Cas enzyme is typically an ortholog of the first CRISPR enzyme or Cas enzyme. In some embodiments, the second CRISPR enzyme or Cas enzyme may be any of the orthologs described herein. In some embodiments, the second CRISPR enzyme or Cas enzyme is Sa. In some embodiments, the second CRISPR enzyme or Cas enzyme is an St enzyme. In some embodiments, the second CRISPR enzyme or Cas enzyme is an St3 enzyme.

The internal component of the second CRISPR enzyme or Cas enzyme does not comprise any amino acids that would be at, or within, 2 or 3 amino acids from the N' or C' terminal ends of the functional wild type second CRISPR enzyme or Cas enzyme (including any post-transcriptional processing). A minimal distance from the N' or C' terminal ends of functional wild type second CRISPR enzyme or Cas enzyme would ideally be 5 to 10 amino acids, in some embodiments.

The components of the first CRISPR enzyme or Cas enzyme or the second CRISPR enzyme or Cas enzyme may, in some embodiments, comprise at least one domain or may span the boundaries between two or more domains. Examples of this can be seen in Example 24 and FIG. 86B where the components swapped in an out of the Sp Cas9 (being the first CRISPR enzyme or Cas enzyme) span the boundaries of the various domains identified in FIG. 86A. In some embodiments, one or more full domains are preferred. In some embodiments, one or more partial domains are preferred. In some embodiments, the Rec lobe is fully or partially swapped out, so that the internal component from a second CRISPR enzyme or Cas enzyme comprises a full or partial Rec lobe. As such, the N' and C' terminal components from a first CRISPR enzyme or Cas enzyme would lack the Rec lobe.

In some embodiments, the internal component of the second CRISPR enzyme or Cas enzyme is the HD2 domain.

In some embodiments, the internal component of the second CRISPR enzyme or Cas enzyme replaces one or more corresponding components in the first CRISPR enzyme or Cas enzyme. In some embodiments, HD2 domain of the first CRISPR enzyme or Cas enzyme is truncated or replaced entirely. The truncation may be by at least 20%, more preferably by at least 30%, more preferably by at least 40%, more preferably by at least 50%, more preferably by at least 60%, more preferably by at least 70%, more preferably by at least 70%, more preferably by at least 80%, more preferably by at least 90%, more preferably by at least 95%, more preferably by at least 98%, and more preferably by at least 99%. As mentioned above, a suitable example of an HD2 domain (in this instance from Sp Cas9) is provided in Example 9 and examples of truncated sequences lacking said HD2 domain are also provided for guidance. In some embodiments, the components may be only portions of domains, for example a preferred N' terminal component is amino acids 1-10 of Sp which is only part of the RuvCI domain in Sp.

In some embodiments, the internal component from the first CRISPR enzyme or Cas enzyme is replaced by an internal component from the second CRISPR enzyme or Cas enzyme. The two said internal components may be the same (i.e. correspond to one another between orthologs, comparable by sequence alignment for instance) or different.

In some embodiments, the chimeric 3-component enzyme comprises N' and C' terminal components from Sp Cas9, and internal domains from Sa or St3. This provides Sp-St3-Sp or Sp-Sa-Sp chimeric 3 component enzymes (in the N' to C' direction).

In some embodiments, the N' terminal component of the first CRISPR enzyme or Cas enzyme is Sp 1-10 (amino acids 1-10 of Sp Cas 9). In some embodiments, the N' terminal component of the first CRISPR enzyme or Cas enzyme is Sp 1-189. In some embodiments, the N' terminal component of the first CRISPR enzyme or Cas enzyme is Sp 1-299.

In some embodiments, the C' terminal component of the first CRISPR enzyme or Cas enzyme is Sp 729-1404. In some embodiments, the C' terminal component of the first CRISPR enzyme or Cas enzyme is Sp 190-1404. In some embodiments, the C' terminal component of the first CRISPR enzyme or Cas enzyme is Sp 328-1404.

In some embodiments, the internal component of the second CRISPR enzyme or Cas enzyme is St3 87-712. In some embodiments, the internal component of the second CRISPR enzyme or Cas enzyme is St3 174-712. In some embodiments, the internal component of the second CRISPR enzyme or Cas enzyme is St3 87-173. In some embodiments, the internal component of the second CRISPR enzyme or Cas enzyme is St3 174-311. In some embodiments, the internal component of the second CRISPR enzyme or Cas enzyme is St3 312-712. Thus, in some embodiments, suitable lower range points for the internal component of the second CRISPR enzyme or Cas enzyme is St3 87, or 174, or 312. Also, in some embodiments, suitable upper range points for the internal component of the second CRISPR enzyme or Cas enzyme is St3 712, or 172/173, or 311. Any of these combinations are preferred, except where the upper and lower end points are adjacent each other or at least within 10 amino acids.

In some embodiments, the internal component of the second CRISPR enzyme or Cas enzyme is Sa 125-200. In some embodiments, the internal component of the second CRISPR enzyme or Cas enzyme is Sa 125-200 and the N' terminal component of the first CRISPR enzyme or Cas enzyme is Sp 1-189 and the C' terminal component of the first CRISPR enzyme or Cas enzyme is Sp 328-1404.

Some variation on these boundaries (except where the amino acid is the very first or very last of the wildtype) is envisaged, bearing in mind the requirement above regarding distances from the ends. Suitable ranges of these boundaries would be in the region of 1, 2, 3, 4, 5, 8, 10 15 or 20 amino acids.

It will be appreciated that the chimeric 3-component CRISPR enzyme or Cas9 enzyme is functional and preferably has at least at least 20%, more preferably at least 30%, more preferably at least 40%, more preferably at least 50%, more preferably at least 60%, more preferably at least 70%, more preferably at least 70%, more preferably at least 80%, more preferably at least 90%, more preferably at least 95%, more preferably at least 98%, and more preferably at least 99% or more preferably 100% or more of the activity of the wildtype enzyme (an enzyme not modified as herein discussed).

Hybrid guides are preferred for use with the chimeric 3-component CRISPR enzyme or Cas9 enzyme, in some embodiments. A hybrid guides comprises a backbone and a targeting sequence. The backbone comprises the tracr RNA scaffold (tracr mate and tracr sequence) and the targeting sequence comprises the guide (spacer) sequence, of approx. 20 nts for DNA targeting. The backbone may correspond to that from an endogenous a guide from the same species as the first CRISPR enzyme or Cas enzyme or the backbone may correspond to that from an endogenous a guide from the same species as the second CRISPR enzyme or Cas enzyme. The targeting sequence may correspond to that from an endogenous a guide from the same species as the first CRISPR enzyme or Cas enzyme or the targeting sequence may correspond to that from an endogenous a guide from the same species as the second CRISPR enzyme or Cas enzyme.

Figure 27A:
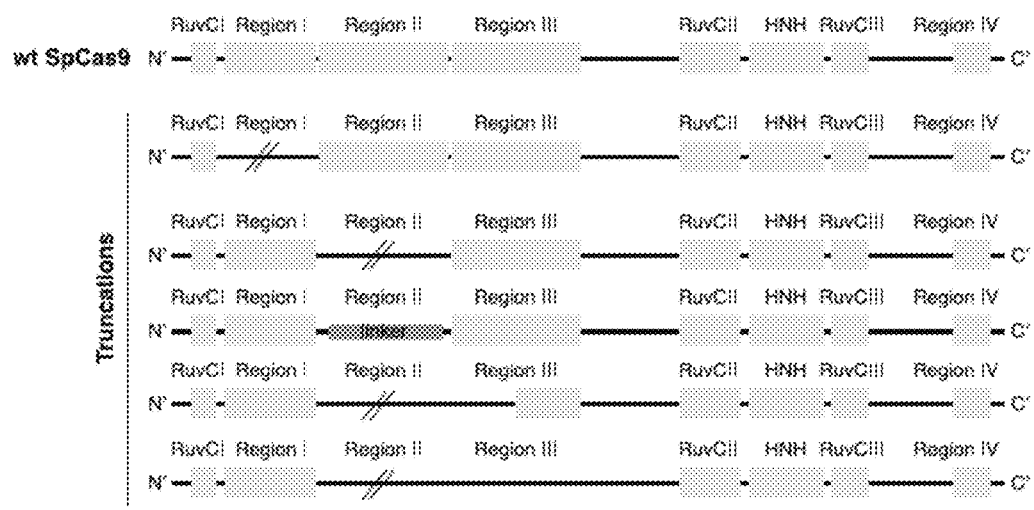
FIGS. 27A-C show truncation and creation of chimeric (S. pyogenes) Cas9s based on the herein crystal structure, including mutants for mapping essential functional domains (A), chimeras that contain regions from S. thermophilus Cas9 (B), and designs for chemically inducible dimerization of SpCas9 (C).
Figure 27B:
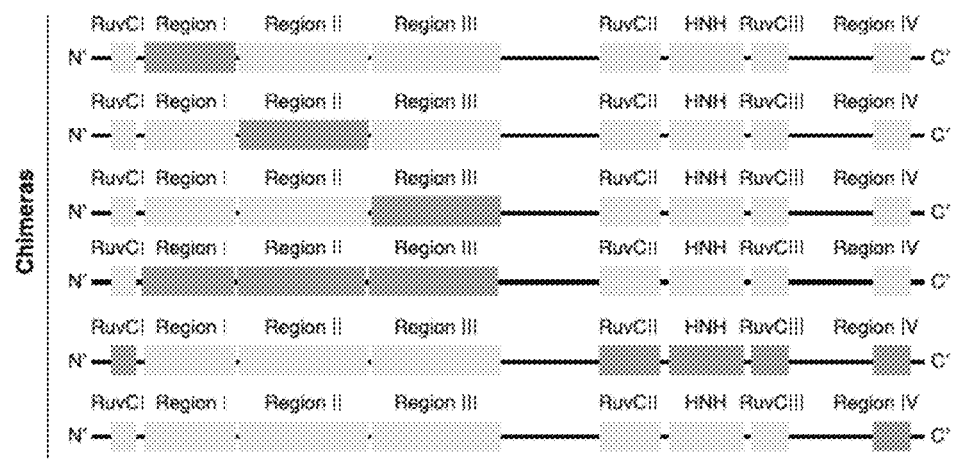
Figure 27C:
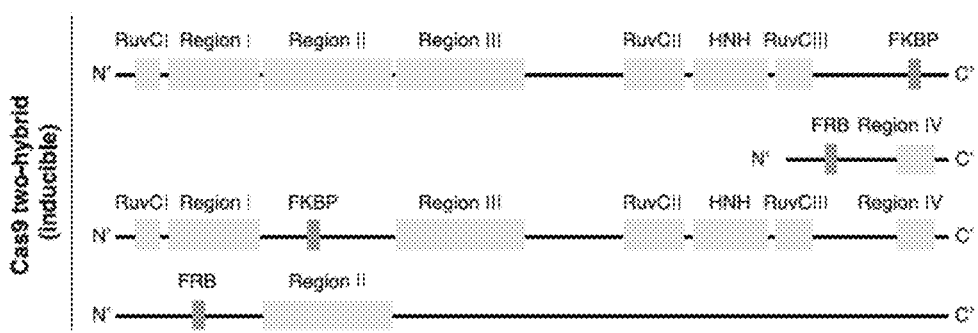
Figure 28:
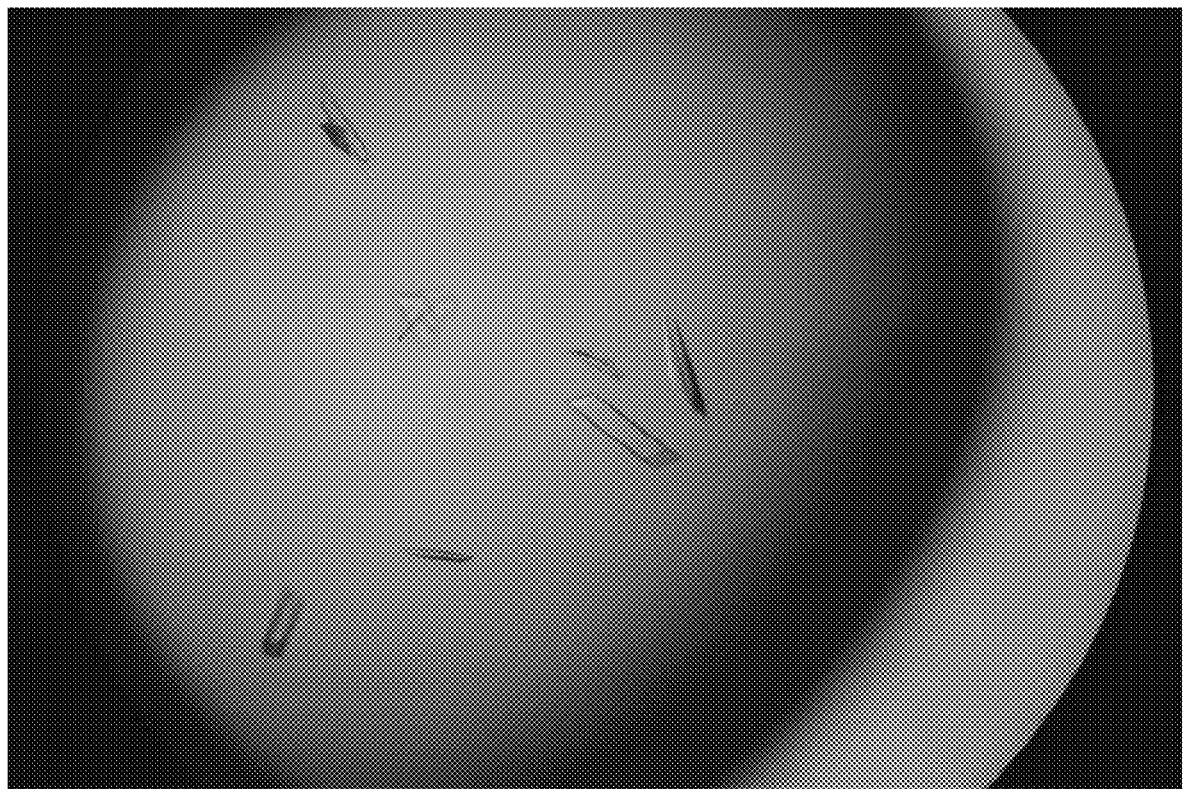
FIG. 28 shows a picture of Cas9 crystals (0.2 mm).
Figure 29:
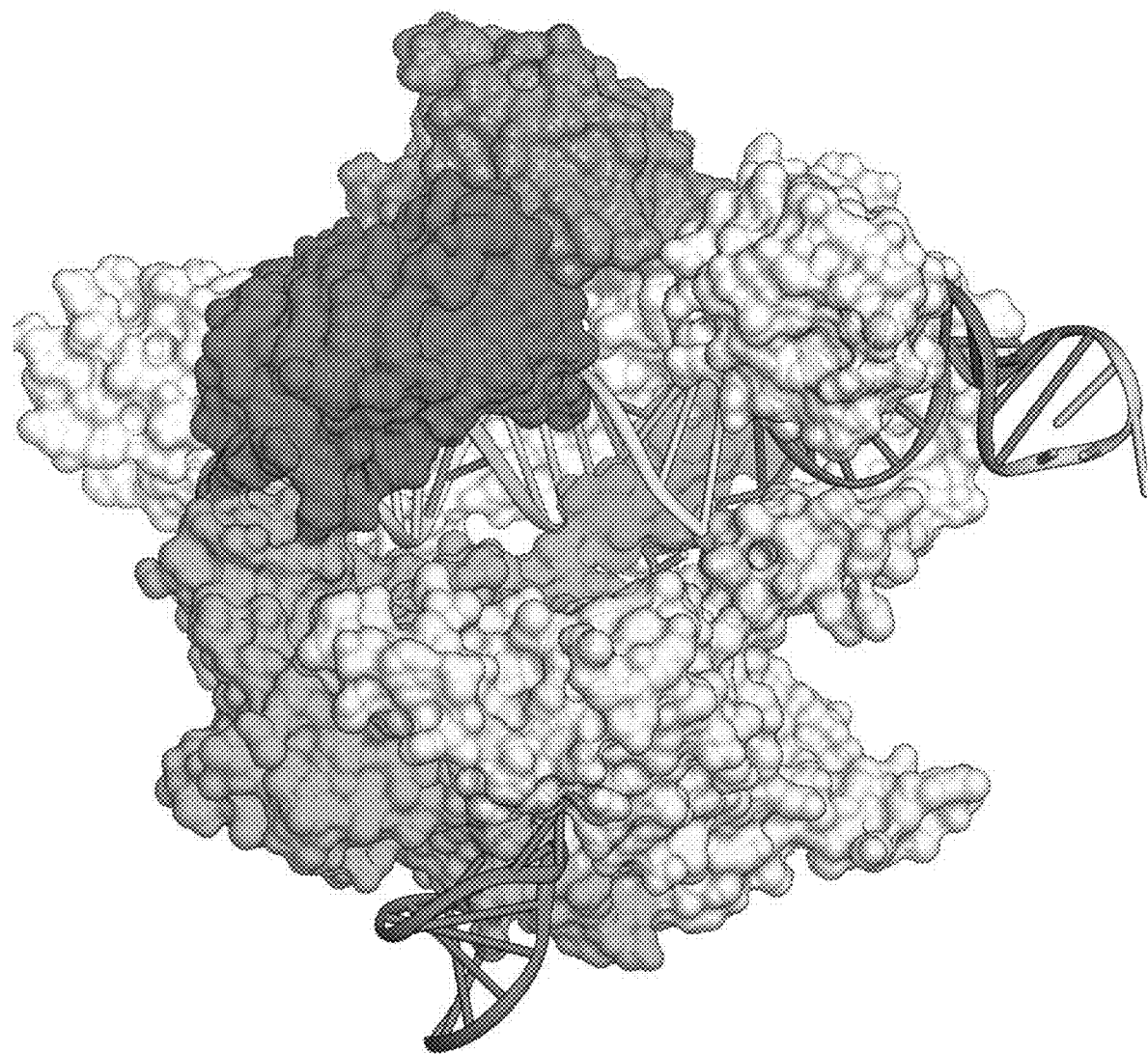
FIG. 29 shows a structural figure of showing Cas9 in a surface representation; red, sgRNA; cyan, the guide region of sgRNA; gold, target DNA.

Exemplary arrangement for truncations and chimeric 3-component CRISPR enzyme or Cas9 enzymes are shown in FIGS. 27 A and B, with reference to wt Sp Cas9, except for the last chimera in FIG. 27B which is a two-component chimera. The truncation shown in the third arrangement in FIG. 27A is preferred as this is an HD2 truncation and wherein the HDS region has been replaced by a linker. Suitable linkers are Gly Ser linkers as discussed herein or alpha-helical linkers (Ala(GluAlaAlaAlaLys)Ala) (SEQ ID NO: 2).

The CRISPR-Cas enzymes described herein are preferably type II CRISPR-Cas enzymes. In some embodiments it may be preferred in a CRISPR complex that the tracr sequence has one or more hairpins and is 30 or more nucleotides in length, 40 or more nucleotides in length, or 50 or more nucleotides in length; the guide sequence is between 10 to 30 nucleotides in length, the CRISPR/Cas enzyme is a Type II Cas9 enzyme.

With respect to general information on CRISPR-Cas Systems, components thereof, and delivery of such components, including methods, materials, delivery vehicles, vectors, particles, AAV, and making and using thereof, including as to amounts and formulations, all useful in the practice of the instant invention, reference is made to: U.S. Pat. Nos. 8,697,359, 8,771,945, 8,795,965, 8,865,406, 8,871,445, 8,889,356, 8,889,418 and 8,895,308; US Patent Publications US 2014-0310830 (U.S. application Ser. No. 14/105,031), US 2014-0287938 A1 (U.S. application Ser. No. 14/213,991), US 2014-0273234 A1 (U.S. application Ser. No. 14/293,674), US2014-0273232 A1 (U.S. application Ser. No. 14/290,575), US 2014-0273231 (U.S. application Ser. No. 14/259,420), US 2014-0256046 A1 (U.S. application Ser. No. 14/226,274), US 2014-0248702 A1 (U.S. application Ser. No. 14/258,458), US 2014-0242700 A1 (U.S. application Ser. No. 14/222,930), US 2014-0242699 A1 (U.S. application Ser. No. 14/183,512), US 2014-0242664 A1 (U.S. application Ser. No. 14/104,990), US 2014-0234972 A1 (U.S. application Ser. No. 14/183,471), US 2014-0227787 A1 (U.S. application Ser. No. 14/256,912), US 2014-0189896 A1 (U.S. application Ser. No. 14/105,035), US 2014-0186958 (U.S. application Ser. No. 14/105,017), US 2014-0186919 A1 (U.S. application Ser. No. 14/104,977), US 2014-0186843 A1 (U.S. application Ser. No. 14/104,900), US 2014-0179770 A1 (U.S. application Ser. No. 14/104,837) and US 2014-0179006 A1 (U.S. application Ser. No. 14/183,486), US 2014-0170753 (U.S. application Ser. No. 14/183,429); European Patent Applications EP 2 771 468 (EP13818570.7), EP 2 764 103 (EP13824232.6), and EP 2 784 162 (EP14170383.5); and PCT Patent Publications WO 2014/093661 (PCT/US2013/074743), WO 2014/093694 (PCT/US2013/074790), WO 2014/093595 (PCT/US2013/074611), WO 2014/093718 (PCT/US2013/074825), WO 2014/093709 (PCT/US2013/074812), WO 2014/093622 (PCT/US2013/074667), WO 2014/093635 (PCT/US2013/074691), WO 2014/093655 (PCT/US2013/074736), WO 2014/093712 (PCT/US2013/074819), WO2014/093701 (PCT/US2013/074800), and WO2014/018423 (PCT/US2013/051418). Reference is also made to U.S. provisional patent applications 61/758,468; 61/802,174; 61/806,375; 61/814,263; 61/819,803 and 61/828,130, filed on Jan. 30, 2013; Mar. 15, 2013; Mar. 28, 2013; Apr. 20, 2013; May 6, 2013 and May 28, 2013 respectively. Reference is also made to U.S. provisional patent application 61/836,123, filed on Jun. 17, 2013. Reference is additionally made to U.S. provisional patent applications 61/835,931, 61/835,936, 61/836,127, 61/836,101, 61/836,080 and 61/835,973, each filed Jun. 17, 2013. Further reference is made to U.S. provisional patent applications 61/862,468 and 61/862,355 filed on Aug. 5, 2013; 61/871,301 filed on Aug. 28, 2013; 61/960,777 filed on Sep. 25, 2013 and 61/961,980 filed on Oct. 28, 2013. Reference is yet further made to: PCT Patent applications Nos: PCT/US2014/041803, PCT/US2014/041800, PCT/US2014/041809, PCT/US2014/041804 and PCT/US2014/041806, each filed Jun. 10, 2014; PCT/US2014/041808 filed Jun. 11, 2014; and PCT/US2014/62558 filed Oct. 28, 2014, and U.S. Provisional Patent Application Ser. Nos. 61/915,150, 61/915,301, 61/915,267 and 61/915,260, each filed Dec. 12, 2013; 61/757,972 and 61/768,959, filed on Jan. 29, 2013 and Feb. 25, 2013; 61/835,936, 61/836,127, 61/836,101, 61/836,080, 61/835,973, and 61/835,931, filed Jun. 17, 2013; 62/010,888 and 62/010,879, both filed Jun. 11, 2014; 62/010,329 and 62/010,441, each filed Jun. 10, 2014; 61/939,228 and 61/939,242, each filed Feb. 12, 2014; 61/980,012, filed Apr. 15, 2014; 62/038,358 filed Aug. 17, 2014; 62/054,490, 62/055,484, 62/055,460 and 62/055,487, each filed Sep. 25, 2014; and 62/069,243, filed Oct. 27, 2014. Reference is also made to U.S. provisional patent applications Nos. 62/055,484, 62/055,460, and 62/055,487, filed Sep. 25, 2014; U.S. provisional patent application 61/980,012, filed Apr. 15, 2014; and U.S. provisional patent application 61/939,242 filed Feb. 12, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915,260 and 61/915,267, each filed on Dec. 12, 2013. Reference is made to US provisional patent application U.S. Ser. No. 61/980,012 filed Apr. 15, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915,260 and 61/915,267, each filed on Dec. 12, 2013. Each of these patents, patent publications, and applications, and all documents cited therein or during their prosecution ("appln cited documents") and all documents cited or referenced in the appln cited documents, together with any instructions, descriptions, product specifications, and product sheets for any products mentioned therein or in any document therein and incorporated by reference herein, are hereby incorporated herein by reference, and may be employed in the practice of the invention. All documents (e.g., these patents, patent publications and applications and the appln cited documents) are incorporated herein by reference to the same extent as if each individual document was specifically and individually indicated to be incorporated by reference.

Also with respect to general information on CRISPR-Cas Systems, mention is made of the following (also hereby incorporated herein by reference):

*Multiplex genome engineering using CRISPR/Cas systems.* Cong, L., Ran, F. A., Cox, D., Lin, S., Barretto, R., Habib, N., Hsu, P. D., Wu, X., Jiang, W., Marraffini, L. A., & Zhang, F. Science February 15; 339(6121):819-23 (2013);

*RNA-guided editing of bacterial genomes using CRISPR-Cas systems.* Jiang W., Bikard D., Cox D., Zhang F, Marraffini L A. Nat Biotechnol March; 31(3):233-9 (2013);

*One-Step Generation of Mice Carrying Mutations in Multiple Genes by CRISPR/Cas-Mediated Genome Engineering.* Wang H., Yang H., Shivalila C S., Dawlaty M M., Cheng A W., Zhang F., Jaenisch R. Cell May 9; 153(4): 910-8 (2013);

*Optical control of mammalian endogenous transcription and epigenetic states.* Konermann S, Brigham M D, Trevino A E, Hsu P D, Heidenreich M, Cong L, Platt R J, Scott D A, Church G M, Zhang F. Nature. 2013 Aug. 22; 500(7463):472-6. doi: 10.1038 Nature12466. Epub 2013 Aug. 23;

*Double Nicking by RNA-Guided CRISPR Cas9 for Enhanced Genome Editing Specificity*. Ran, F A., Hsu, P D., Lin, C Y., Gootenberg, J S., Konermann, S., Trevino, A E., Scott, D A., Inoue, A., Matoba, S., Zhang, Y., & Zhang, F. *Cell* August 28. pii: S0092-8674(13)01015-5. (2013);

*DNA targeting specificity of RNA guided Cas9 nucleases*. Hsu, P., Scott, D., Weinstein, J., Ran, F A., Konermann, S., Agarwala, V., Li, Y., Fine, E., Wu, X., Shalem, O., Cradick, T J., Marraffini, L A., Bao, G., & Zhang, F. *Nat Biotechnol* doi:10.1038/nbt.2647 (2013);

*Genome engineering using the CRISPR-Cas9 system*. Ran, F A., Hsu, P D., Wright, J., Agarwala, V., Scott, D A., Zhang, F. Nature Protocols November; 8(11):2281-308. (2013);

*Genome-Scale CRISPR-Cas9 Knockout Screening in Human Cells*. Shalem, O., Sanjana, N E., Hartenian, E., Shi, X., Scott, D A., Mikkelson, T., Heckl, D., Ebert, B L., Root, D E., Doench, J G., Zhang, F. *Science* December 12. (2013). [Epub ahead of print];

*Crystal structure of cas9 in complex with guide RNA and target DNA*. Nishimasu, H., Ran, F A., Hsu, P D., Konermann, S., Shehata, S I., Dohmae, N., Ishitani, R., Zhang, F., Nureki, O. *Cell* February 27. (2014). 156(5):935-49;

*Genome-wide binding of the CRISPR endonuclease Cas9 in mammalian cells*. Wu X., Scott D A., Kriz A J., Chiu A C., Hsu P D., Dadon D B., Cheng A W., Trevino A E., Konermann S., Chen S., Jaenisch R., Zhang F., Sharp P A. *Nat Biotechnol*. (2014) April 20. doi: 10.1038/nbt.2889,

*CRISPR-Cas9 Knockin Mice for Genome Editing and Cancer Modeling*, Platt et al., Cell 159(2): 440-455 (2014) DOI: 10.1016/j.cell.2014.09.014,

*Development and Applications of CRISPR-Cas9 for Genome Engineering*, Hsu et al, Cell 157, 1262-1278 (Jun. 5, 2014) (Hsu 2014),

*Genetic screens in human cells using the CRISPR/Cas9 system*, Wang et al., Science. 2014 Jan. 3; 343(6166): 80-84. doi:10.1126/science.1246981,

*Rational design of highly active sgRNAs for CRISPR-Cas9-mediated gene inactivation*, Doench et al., Nature Biotechnology published online 3 Sep. 2014; doi:10.1038/nbt.3026, and

*In vivo interrogation of gene function in the mammalian brain using CRISPR-Cas9*, Swiech et al, Nature Biotechnology; published online 19 Oct. 2014; doi:10.1038/nbt.3055.

each of which is incorporated herein by reference, and discussed briefly below:

Cong et al. engineered type II CRISPR/Cas systems for use in eukaryotic cells based on both *Streptococcus thermophilus* Cas9 and also *Streptoccocus pyogenes* Cas9 and demonstrated that Cas9 nucleases can be directed by short RNAs to induce precise cleavage of DNA in human and mouse cells. Their study further showed that Cas9 as converted into a nicking enzyme can be used to facilitate homology-directed repair in eukaryotic cells with minimal mutagenic activity. Additionally, their study demonstrated that multiple guide sequences can be encoded into a single CRISPR array to enable simultaneous editing of several at endogenous genomic loci sites within the mammalian genome, demonstrating easy programmability and wide applicability of the RNA-guided nuclease technology. This ability to use RNA to program sequence specific DNA cleavage in cells defined a new class of genome engineering tools. These studies further showed that other CRISPR loci are likely to be transplantable into mammalian cells and can also mediate mammalian genome cleavage. Importantly, it can be envisaged that several aspects of the CRISPR/Cas system can be further improved to increase its efficiency and versatility.

Jiang et al. used the clustered, regularly interspaced, short palindromic repeats (CRISPR)-associated Cas9 endonuclease complexed with dual-RNAs to introduce precise mutations in the genomes of *Streptococcus pneumoniae* and *Escherichia coli*. The approach relied on dual-RNA:Cas9-directed cleavage at the targeted genomic site to kill unmutated cells and circumvents the need for selectable markers or counter-selection systems. The study reported reprogramming dual-RNA:Cas9 specificity by changing the sequence of short CRISPR RNA (crRNA) to make single- and multinucleotide changes carried on editing templates. The study showed that simultaneous use of two crRNAs enabled multiplex mutagenesis. Furthermore, when the approach was used in combination with recombineering, in *S. pneumoniae*, nearly 100% of cells that were recovered using the described approach contained the desired mutation, and in *E. coli*, 65% that were recovered contained the mutation.

Konermann et al. addressed the need in the art for versatile and robust technologies that enable optical and chemical modulation of DNA-binding domains based CRISPR Cas9 enzyme and also Transcriptional Activator Like Effectors Cas9 nuclease from the microbial CRISPR-Cas system is targeted to specific genomic loci by a 20 nt guide sequence, which can tolerate certain mismatches to the DNA target and thereby promote undesired off-target mutagenesis. To address this, Ran et al. described an approach that combined a Cas9 nickase mutant with paired guide RNAs to introduce targeted double-strand breaks. Because individual nicks in the genome are repaired with high fidelity, simultaneous nicking via appropriately offset guide RNAs is required for double-stranded breaks and extends the number of specifically recognized bases for target cleavage. The authors demonstrated that using paired nicking can reduce off-target activity by 50- to 1,500-fold in cell lines and to facilitate gene knockout in mouse zygotes without sacrificing on-target cleavage efficiency. This versatile strategy enables a wide variety of genome editing applications that require high specificity.

Hsu et al. characterized SpCas9 targeting specificity in human cells to inform the selection of target sites and avoid off-target effects. The study evaluated >700 guide RNA variants and SpCas9-induced indel mutation levels at >100 predicted genomic off-target loci in 293T and 293FT cells. The authors reported that SpCas9 tolerates mismatches between guide RNA and target DNA at different positions in a sequence-dependent manner, sensitive to the number, position and distribution of mismatches. The authors further showed that SpCas9-mediated cleavage is unaffected by DNA methylation and that the dosage of SpCas9 and sgRNA can be titrated to minimize off-target modification. Additionally, to facilitate mammalian genome engineering applications, the authors reported providing a web-based software tool to guide the selection and validation of target sequences as well as off-target analyses.

Ran et al. described a set of tools for Cas9-mediated genome editing via non-homologous end joining (NHEJ) or homology-directed repair (HDR) in mammalian cells, as well as generation of modified cell lines for downstream functional studies. To minimize off-target cleavage, the authors further described a double-nicking strategy using the Cas9 nickase mutant with paired guide RNAs. The protocol provided by the authors experimentally derived guidelines for the selection of target sites, evaluation of cleavage efficiency and analysis of off-target activity. The studies showed that beginning with target design, gene modifications can be achieved within as little as 1-2 weeks, and modified clonal cell lines can be derived within 2-3 weeks.

Shalem et al. described a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Nishimasu et al. reported the crystal structure of *Streptococcus pyogenes* Cas9 in complex with sgRNA and its target DNA at 2.5 A° resolution. The structure revealed a bilobed architecture composed of target recognition and nuclease lobes, accommodating the sgRNA:DNA heteroduplex in a positively charged groove at their interface. Whereas the recognition lobe is essential for binding sgRNA and DNA, the nuclease lobe contains the HNH and RuvC nuclease domains, which are properly positioned for cleavage of the complementary and non-complementary strands of the target DNA, respectively. The nuclease lobe also contains a carboxyl-terminal domain responsible for the interaction with the protospacer adjacent motif (PAM). This high-resolution structure and accompanying functional analyses have revealed the molecular mechanism of RNA-guided DNA targeting by Cas9, thus paving the way for the rational design of new, versatile genome-editing technologies.

Wu et al. mapped genome-wide binding sites of a catalytically inactive Cas9 (dCas9) from *Streptococcus pyogenes* loaded with single guide RNAs (sgRNAs) in mouse embryonic stem cells (mESCs). The authors showed that each of the four sgRNAs tested targets dCas9 to between tens and thousands of genomic sites, frequently characterized by a 5-nucleotide seed region in the sgRNA and an NGG protospacer adjacent motif (PAM). Chromatin inaccessibility decreases dCas9 binding to other sites with matching seed sequences; thus 70% of off-target sites are associated with genes. The authors showed that targeted sequencing of 295 dCas9 binding sites in mESCs transfected with catalytically active Cas9 identified only one site mutated above background levels. The authors proposed a two-state model for Cas9 binding and cleavage, in which a seed match triggers binding but extensive pairing with target DNA is required for cleavage.

Hsu 2014 is a review article that discusses generally CRISPR-Cas9 history from yogurt to genome editing, including genetic screening of cells, that is in the information, data and findings of the applications in the lineage of this specification filed prior to Jun. 5, 2014. The general teachings of Hsu 2014 do not involve the specific models, animals of the instant specification.

Mention is also made of Tsai et al, "Dimeric CRISPR RNA-guided FokI nucleases for highly specific genome editing," Nature Biotechnology 32(6): 569-77 (2014) which is not believed to be prior art to the instant invention or application, but which may be considered in the practice of the instant invention.

In general, the CRISPR-Cas or CRISPR system is as used in the foregoing documents, such as WO 2014/093622 (PCT/US2013/074667) and refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise any polynucleotide, such as DNA or RNA polynucleotides. In some embodiments, a target sequence is located in the nucleus or cytoplasm of a cell. In some embodiments, direct repeats may be identified in silico by searching for repetitive motifs that fulfill any or all of the following criteria: 1. found in a 2 Kb window of genomic sequence flanking the type II CRISPR locus; 2. span from 20 to 50 bp; and 3. interspaced by 20 to 50 bp. In some embodiments, 2 of these criteria may be used, for instance 1 and 2, 2 and 3, or 1 and 3. In some embodiments, all 3 criteria may be used.

The terms "polynucleotide", "nucleotide", "nucleotide sequence", "nucleic acid" and "oligonucleotide" are used interchangeably. They refer to a polymeric form of nucleotides of any length, either deoxyribonucleotides or ribonucleotides, or analogs thereof. Polynucleotides may have any three dimensional structure, and may perform any function, known or unknown. The following are non limiting examples of polynucleotides: coding or non-coding regions of a gene or gene fragment, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, and primers. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non nucleotide components. A polynucleotide may be further modified after polymerization, such as by conjugation with a labeling component.

Figure 1:
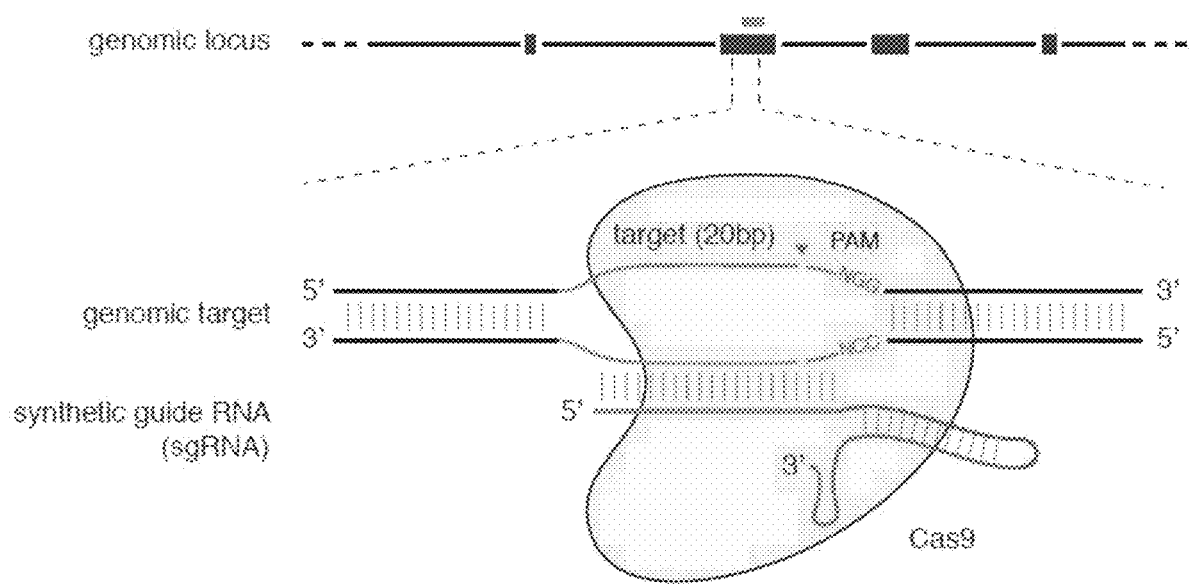
FIG. 1 shows a schematic model of the CRISPR system. The Cas9 nuclease from *Streptococcus pyogenes* (yellow) is targeted to genomic DNA by a synthetic guide RNA (sgRNA) consisting of a 20-nt guide sequence (blue) and a scaffold (red). The guide sequence base-pairs with the DNA target (blue), directly upstream of a requisite 5'-NGG protospacer adjacent motif (PAM; magenta), and Cas9 mediates a double-stranded break (DSB) ~3 bp upstream of the PAM (red triangle).

In aspects of the invention the terms "chimeric RNA", "chimeric guide RNA", "guide RNA", "single guide RNA" and "synthetic guide RNA" are used interchangeably and refer to the polynucleotide sequence comprising the guide sequence, the tracr sequence and the tracr mate sequence. The term "guide sequence" refers to the about 20 bp sequence within the guide RNA that specifies the target site and may be used interchangeably with the terms "guide" or "spacer". The term "tracr mate sequence" may also be used interchangeably with the term "direct repeat(s)". An exemplary CRISPR-Cas system is illustrated in FIG. 1.

As used herein the term "wild type" is a term of the art understood by skilled persons and means the typical form of an organism, strain, gene or characteristic as it occurs in nature as distinguished from mutant or variant forms.

As used herein the term "variant" should be taken to mean the exhibition of qualities that have a pattern that deviates from what occurs in nature.

The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature.

"Complementarity" refers to the ability of a nucleic acid to form hydrogen bond(s) with another nucleic acid sequence by either traditional Watson-Crick or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions.

As used herein, "stringent conditions" for hybridization refer to conditions under which a nucleic acid having complementarity to a target sequence predominantly hybridizes with the target sequence, and substantially does not hybridize to non-target sequences. Stringent conditions are generally sequence-dependent, and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part I, Second Chapter "Overview of principles of hybridization and the strategy of nucleic acid probe assay", Elsevier, N.Y.

"Hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence specific manner. The complex may comprise two strands forming a duplex structure, three or more strands forming a multi stranded complex, a single self hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence.

As used herein, "expression" refers to the process by which a polynucleotide is transcribed from a DNA template (such as into and mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell.

The terms "polypeptide", "peptide" and "protein" are used interchangeably herein to refer to polymers of amino acids of any length. The polymer may be linear or branched, it may comprise modified amino acids, and it may be interrupted by non amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics.

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

The terms "therapeutic agent", "therapeutic capable agent" or "treatment agent" are used interchangeably and refer to a molecule or compound that confers some beneficial effect upon administration to a subject. The beneficial effect includes enablement of diagnostic determinations; amelioration of a disease, symptom, disorder, or pathological condition; reducing or preventing the onset of a disease, symptom, disorder or condition; and generally counteracting a disease, symptom, disorder or pathological condition.

As used herein, "treatment" or "treating," or "palliating" or "ameliorating" are used interchangeably. These terms refer to an approach for obtaining beneficial or desired results including but not limited to a therapeutic benefit and/or a prophylactic benefit. By therapeutic benefit is meant any therapeutically relevant improvement in or effect on one or more diseases, conditions, or symptoms under treatment. For prophylactic benefit, the compositions may be administered to a subject at risk of developing a particular disease, condition, or symptom, or to a subject reporting one or more of the physiological symptoms of a disease, even though the disease, condition, or symptom may not have yet been manifested.

The term "effective amount" or "therapeutically effective amount" refers to the amount of an agent that is sufficient to effect beneficial or desired results. The therapeutically effective amount may vary depending upon one or more of: the subject and disease condition being treated, the weight and age of the subject, the severity of the disease condition, the manner of administration and the like, which can readily be determined by one of ordinary skill in the art. The term also applies to a dose that will provide an image for detection by any one of the imaging methods described herein. The specific dose may vary depending on one or more of: the particular agent chosen, the dosing regimen to be followed, whether it is administered in combination with other compounds, timing of administration, the tissue to be imaged, and the physical delivery system in which it is carried.

The practice of the present invention employs, unless otherwise indicated, conventional techniques of immunology, biochemistry, chemistry, molecular biology, microbiology, cell biology, genomics and recombinant DNA, which are within the skill of the art. See Sambrook, Fritsch and Maniatis, MOLECULAR CLONING: A LABORATORY MANUAL, 2nd edition (1989); CURRENT PROTOCOLS IN MOLECULAR BIOLOGY (F. M. Ausubel, et al. eds., (1987)); the series METHODS IN ENZYMOLOGY (Academic Press, Inc.): PCR 2: A PRACTICAL APPROACH (M. J. MacPherson, B. D. Hames and G. R. Taylor eds. (1995)), Harlow and Lane, eds. (1988) ANTIBODIES, A LABORATORY MANUAL, and ANIMAL CELL CULTURE (R. I. Freshney, ed. (1987)).

Several aspects of the invention relate to vector systems comprising one or more vectors, or vectors as such. Vectors can be designed for expression of CRISPR transcripts (e.g. nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Vectors may be introduced and propagated in a prokaryote. In some embodiments, a prokaryote is used to amplify copies of a vector to be introduced into a eukaryotic cell or as an intermediate vector in the production of a vector to be introduced into a eukaryotic cell (e.g. amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. Gene 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein.

Examples of suitable inducible non-fusion *E. coli* expression vectors include pTrc (Amrann et al., (1988) Gene 69:301-315) and pET 11d (Studier et al., GENE EXPRESSION TECHNOLOGY: METHODS IN ENZYMOLOGY 185, Academic Press, San Diego, Calif. (1990) 60-89).

In some embodiments, a vector is a yeast expression vector. Examples of vectors for expression in yeast *Saccharomyces cerivisae* include pYepSec1 (Baldari, et al., 1987. *EMBO J.* 6: 229-234), pMFa (Kuijan and Herskowitz, 1982. *Cell* 30: 933-943), pJRY88 (Schultz et al., 1987. *Gene* 54: 113-123), pYES2 (Invitrogen Corporation, San Diego, Calif.), and picZ (InVitrogen Corp, San Diego, Calif.).

In some embodiments, a vector drives protein expression in insect cells using baculovirus expression vectors. Baculovirus vectors available for expression of proteins in cultured insect cells (e.g., SF9 cells) include the pAc series (Smith, et al., 1983. *Mol. Cell. Biol.* 3: 2156-2165) and the pVL series (Lucklow and Summers, 1989. *Virology* 170: 31-39).

In some embodiments, a vector is capable of driving expression of one or more sequences in mammalian cells using a mammalian expression vector. Examples of mammalian expression vectors include pCDM8 (Seed, 1987. *Nature* 329: 840) and pMT2PC (Kaufman, et al., 1987. *EMBO J.* 6: 187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1: 268-277), lymphoid-specific promoters (Calame and Eaton, 1988. *Adv. Immunol.* 43: 235-275), in particular promoters of T cell receptors (Winoto and Baltimore, 1989. *EMBO J.* 8: 729-733) and immunoglobulins (Baneiji, et al., 1983. *Cell* 33: 729-740; Queen and Baltimore, 1983. *Cell* 33: 741-748), neuron-specific promoters (e.g., the neurofilament promoter; Byrne and Ruddle, 1989. *Proc. Natl. Acad. Sci. USA* 86: 5473-5477), pancreas-specific promoters (Edlund, et al., 1985. *Science* 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. *Science* 249: 374-379) and the α-fetoprotein promoter (Campes and Tilghman, 1989. *Genes Dev.* 3: 537-546).

In some embodiments, a regulatory element is operably linked to one or more elements of a CRISPR system so as to drive expression of the one or more elements of the CRISPR system. In general, CRISPRs (Clustered Regularly Interspaced Short Palindromic Repeats), also known as SPIDRs (SPacer Interspersed Direct Repeats), constitute a family of DNA loci that are usually specific to a particular bacterial species. The CRISPR locus comprises a distinct class of interspersed short sequence repeats (SSRs) that were recognized in *E. coli* (Ishino et al., J. Bacteriol., 169:5429-5433 [1987]; and Nakata et al., J. Bacteriol., 171:3553-3556 [1989]), and associated genes. Similar interspersed SSRs have been identified in *Haloferax mediterranei, Streptococcus pyogenes, Anabaena*, and *Mycobacterium tuberculosis*

(See, Groenen et al., Mol. Microbiol., 10:1057-1065 [1993]; Hoe et al., Emerg. Infect. Dis., 5:254-263 [1999]; Masepohl et al., Biochim. Biophys. Acta 1307:26-30 [1996]; and Mojica et al., Mol. Microbiol., 17:85-93 [1995]). The CRISPR loci typically differ from other SSRs by the structure of the repeats, which have been termed short regularly spaced repeats (SRSRs) (Janssen et al., OMICS J. Integ. Biol., 6:23-33 [2002]; and Mojica et al., Mol. Microbiol., 36:244-246 [2000]). In general, the repeats are short elements that occur in clusters that are regularly spaced by unique intervening sequences with a substantially constant length (Mojica et al., [2000], supra). Although the repeat sequences are highly conserved between strains, the number of interspersed repeats and the sequences of the spacer regions typically differ from strain to strain (van Embden et al., J. Bacteriol., 182:2393-2401 [2000]). CRISPR loci have been identified in more than 40 prokaryotes (See e.g., Jansen et al., Mol. Microbiol., 43:1565-1575 [2002]; and Mojica et al., [2005]) including, but not limited to *Aeropyrum, Pyrobaculum, Sulfolobus, Archaeoglobus, Halocarcula, Methanobacterium, Methanococcus, Methanosarcina, Methanopyrus, Pyrococcus, Picrophilus, Thermoplasma, Corynebacterium, Mycobacterium, Streptomyces, Aquifex, Porphyromonas, Chlorobium, Thermus, Bacillus, Listeria, Staphylococcus, Clostridium, Thermoanaerobacter, Mycoplasma, Fusobacterium, Azarcus, Chromobacterium, Neisseria, Nitrosomonas, Desulfovibrio, Geobacter, Myxococcus, Campylobacter, Wolinella, Acinetobacter, Envinia, Escherichia, Legionella, Methylococcus, Pasteurella, Photobacterium, Salmonella, Xanthomonas, Yersinia, Treponema*, and *Thermotoga*.

In general, "CRISPR system" refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or other sequences and transcripts from a CRISPR locus. In some embodiments, one or more elements of a CRISPR system is derived from a type I, type II, or type III CRISPR system. In some embodiments, one or more elements of a CRISPR system is derived from a particular organism comprising an endogenous CRISPR system, such as *Streptococcus pyogenes*. In general, a CRISPR system is characterized by elements that promote the formation of a CRISPR complex at the site of a target sequence (also referred to as a protospacer in the context of an endogenous CRISPR system). In the context of formation of a CRISPR complex, "target sequence" refers to a sequence to which a guide sequence is designed to have complementarity, where hybridization between a target sequence and a guide sequence promotes the formation of a CRISPR complex. Full complementarity is not necessarily required, provided there is sufficient complementarity to cause hybridization and promote formation of a CRISPR complex. A target sequence may comprise any polynucleotide, such as DNA or RNA polynucleotides. In some embodiments, a target sequence is located in the nucleus or cytoplasm of a cell. In some embodiments, the target sequence may be within an organelle of a eukaryotic cell, for example, mitochondrion or chloroplast. A sequence or template that may be used for recombination into the targeted locus comprising the target sequences is referred to as an "editing template" or "editing polynucleotide" or "editing sequence". In aspects of the invention, an exogenous template polynucleotide may be referred to as an editing template. In an aspect of the invention the recombination is homologous recombination.

Figure 22A:
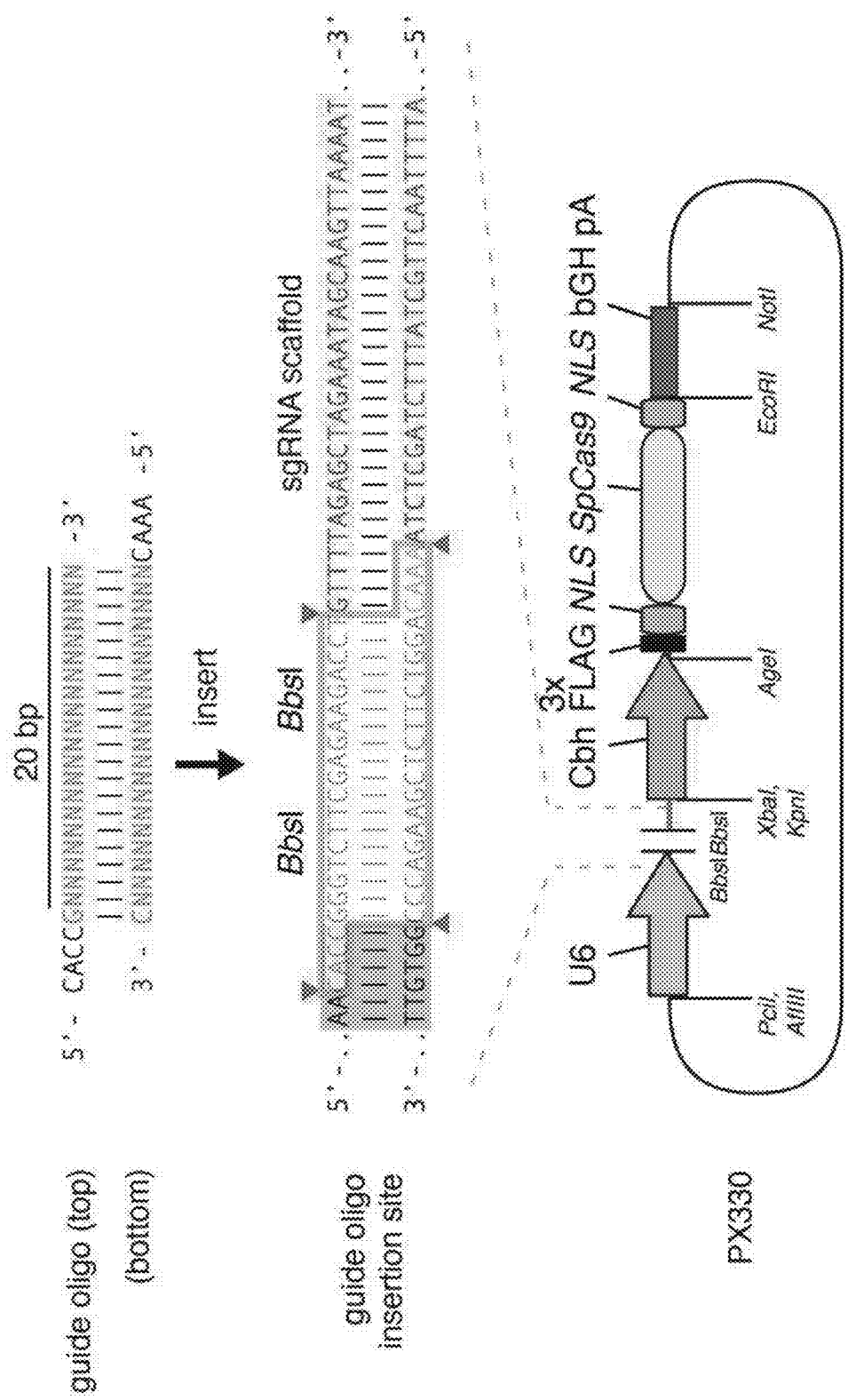
FIG. 22A-B shows single vector designs for SpCas9.

Typically, in the context of an endogenous CRISPR system, formation of a CRISPR complex (comprising a guide sequence hybridized to a target sequence and complexed with one or more Cas proteins) results in cleavage of one or both strands in or near (e.g. within 1, 2, 3, 4, 5, 6, 7, 8, 9, 10, 20, 50, or more base pairs from) the target sequence. Without wishing to be bound by theory, the tracr sequence, which may comprise or consist of all or a portion of a wild-type tracr sequence (e.g. about or more than about 20, 26, 32, 45, 48, 54, 63, 67, 85, or more nucleotides of a wild-type tracr sequence), may also form part of a CRISPR complex, such as by hybridization along at least a portion of the tracr sequence to all or a portion of a tracr mate sequence that is operably linked to the guide sequence. In some embodiments, the tracr sequence has sufficient complementarity to a tracr mate sequence to hybridize and participate in formation of a CRISPR complex. As with the target sequence, it is believed that complete complementarity is not needed, provided there is sufficient to be functional. In some embodiments, the tracr sequence has at least 50%, 60%, 70%, 80%, 90%, 95% or 99% of sequence complementarity along the length of the tracr mate sequence when optimally aligned. In some embodiments, one or more vectors driving expression of one or more elements of a CRISPR system are introduced into a host cell such that expression of the elements of the CRISPR system direct formation of a CRISPR complex at one or more target sites. For example, a Cas enzyme, a guide sequence linked to a tracr-mate sequence, and a tracr sequence could each be operably linked to separate regulatory elements on separate vectors. Alternatively, two or more of the elements expressed from the same or different regulatory elements, may be combined in a single vector, with one or more additional vectors providing any components of the CRISPR system not included in the first vector. CRISPR system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a CRISPR enzyme and one or more of the guide sequence, tracr mate sequence (optionally operably linked to the guide sequence), and a tracr sequence embedded within one or more intron sequences (e.g. each in a different intron, two or more in at least one intron, or all in a single intron). In some embodiments, the CRISPR enzyme, guide sequence, tracr mate sequence, and tracr sequence are operably linked to and expressed from the same promoter. Single vector constructs for SpCas9 are illustrated in FIG. 22.

In some embodiments, a vector comprises one or more insertion sites, such as a restriction endonuclease recognition sequence (also referred to as a "cloning site"). In some embodiments, one or more insertion sites (e.g. about or more than about 1, 2, 3, 4, 5, 6, 7, 8, 9, 10, or more insertion sites) are located upstream and/or downstream of one or more sequence elements of one or more vectors. In some embodiments, a vector comprises an insertion site upstream of a tracr mate sequence, and optionally downstream of a regulatory element operably linked to the tracr mate sequence, such that following insertion of a guide sequence into the insertion site and upon expression the guide sequence directs sequence-specific binding of a CRISPR complex to a target sequence in a eukaryotic cell. In some embodiments, a vector comprises two or more insertion sites, each insertion site being located between two tracr mate sequences so as to allow insertion of a guide sequence at each site. In such an arrangement, the two or more guide sequences may comprise two or more copies of a single guide sequence, two or more different guide sequences, or combinations of these. When multiple different guide sequences are used, a single expression construct may be used to target CRISPR activity to multiple different, corresponding target sequences within a cell. For example, a single vector may comprise about or more than about 1, 2, 3, 4, 5, 6, 7, 8, 9, 10, 15, 20, or more guide sequences. In some embodiments, about or more than about 1, 2, 3, 4, 5, 6, 7, 8, 9, 10, or more such guide-sequence-containing vectors may be provided, and optionally delivered to a cell.

In some embodiments, a vector comprises a regulatory element operably linked to an enzyme-coding sequence encoding a CRISPR enzyme, such as a Cas protein. Non-limiting examples of Cas proteins include Cas1, Cas1B, Cas2, Cas3, Cas4, Cas5, Cash, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologs thereof, or modified versions thereof. These enzymes are known; for example, the amino acid sequence of S. pyogenes Cas9 protein may be found in the SwissProt database under accession number Q99ZW2. In some embodiments, the unmodified CRISPR enzyme has DNA cleavage activity, such as Cas9. In some embodiments the CRISPR enzyme is Cas9, and may be Cas9 from S. pyogenes or S. pneumoniae. In some embodiments, the CRISPR enzyme directs cleavage of one or both strands at the location of a target sequence, such as within the target sequence and/or within the complement of the target sequence. In some embodiments, the CRISPR enzyme directs cleavage of one or both strands within about 1, 2, 3, 4, 5, 6, 7, 8, 9, 10, 15, 20, 25, 50, 100, 200, 500, or more base pairs from the first or last nucleotide of a target sequence. In some embodiments, a vector encodes a CRISPR enzyme that is mutated to with respect to a corresponding wild-type enzyme such that the mutated CRISPR enzyme lacks the ability to cleave one or both strands of a target polynucleotide containing a target sequence. For example, an aspartate-to-alanine substitution (D10A) in the RuvC I catalytic domain of Cas9 from S. pyogenes converts Cas9 from a nuclease that cleaves both strands to a nickase (cleaves a single strand). Other examples of mutations that render Cas9 a nickase include, without limitation, H840A, N854A, and N863A. In aspects of the invention, nickases may be used for genome editing via homologous recombination, For example, FIG. 21 shows genome editing via homologous recombination. FIG. 21 (a) shows the schematic of SpCas9 nickase, with D10A mutation in the RuvC I catalytic domain. (b) Schematic representing homologous recombination (HR) at the human EMX1 locus using either sense or antisense single stranded oligonucleotides as repair templates. (c) Sequence of region modified by HR. d, SURVEYOR assay for wildtype (wt) and nickase (D10A) SpCas9-mediated indels at the EMX1 target 1 locus (n=3). Arrows indicate positions of expected fragment sizes.

In some embodiments, a Cas9 nickase may be used in combination with guide sequence(s), e.g., two guide sequences, which target respectively sense and antisense strands of the DNA target. This combination allows both strands to be nicked and used to induce NHEJ. Applicants have demonstrated (data not shown) the efficacy of two nickase targets (i.e., sgRNAs targeted at the same location but to different strands of DNA) in inducing mutagenic NHEJ. A single nickase (Cas9-D10A with a single sgRNA) is unable to induce NHEJ and create indels but Applicants have shown that double nickase (Cas9-D10A and two sgRNAs targeted to different strands at the same location) can do so in human embryonic stem cells (hESCs). The efficiency is about 50% of nuclease (i.e., regular Cas9 without D10 mutation) in hESCs.

As a further example, two or more catalytic domains of Cas9 (RuvC I, RuvC II, and RuvC III) may be mutated to produce a mutated Cas9 substantially lacking all DNA cleavage activity. In some embodiments, a D10A mutation is combined with one or more of H840A, N854A, or N863A mutations to produce a Cas9 enzyme substantially lacking all DNA cleavage activity. In some embodiments, a CRISPR enzyme is considered to substantially lack all DNA cleavage activity when the DNA cleavage activity of the mutated enzyme is less than about 25%, 10%, 5%, 1%, 0.1%, 0.01%, or lower with respect to its non-mutated form. Other mutations may be useful; where the Cas9 or other CRISPR enzyme is from a species other than S. pyogenes, mutations in corresponding amino acids may be made to achieve similar effects.

In some embodiments, an enzyme coding sequence encoding a CRISPR enzyme is codon optimized for expression in particular cells, such as eukaryotic cells. The eukaryotic cells may be those of or derived from a particular organism, such as a mammal, including but not limited to human, mouse, rat, rabbit, dog, or non-human primate. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database", and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, P A), are also available. In some embodiments, one or more codons (e.g. 1, 2, 3, 4, 5, 10, 15, 20, 25, 50, or more, or all codons) in a sequence encoding a CRISPR enzyme correspond to the most frequently used codon for a particular amino acid.

In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies, ELAND (Illumina, San Diego, Calif.), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

A guide sequence may be selected to target any target sequence. In some embodiments, the target sequence is a sequence within a genome of a cell. Exemplary target sequences include those that are unique in the target genome. For example, for the S. pyogenes Cas9, a unique target sequence in a genome may include a Cas9 target site of the form MMMMMMMMMNNNNNNNNNNNNNXGG (SEQ ID NO: 18) where NNNNNNNNNNNNXGG (SEQ ID NO: 19) (N is A, G, T, or C; and X can be anything) has a single occurrence in the genome. A unique target sequence in a genome may include an S. pyogenes Cas9 target site of the form MMMMMMMMMNNNNNNNNNNNNXGG (SEQ ID NO: 20) where NNNNNNNNNNNNXGG (SEQ ID NO: 21) (N is A, G, T, or C; and X can be anything) has a single occurrence in the genome. For the S. thermophilus CRISPR1 Cas9, a unique target sequence in a genome may include a Cas9 target site of the form MMMMMM-MMNNNNNNNNNNNNXXAGAAW (SEQ ID NO: 22) where NNNNNNNNNNNNXXAGAAW (SEQ ID NO: 23) (N is A, G, T, or C; X can be anything; and W is A or T) has a single occurrence in the genome. A unique target sequence in a genome may include an S. thermophilus CRISPR1 Cas9 target site of the form MMMMMMMM-MMNNNNNNNNNNNNXXAGAAW (SEQ ID NO: 24) where NNNNNNNNNNNNXXAGAAW (SEQ ID NO: 25) (N is A, G, T, or C; X can be anything; and W is A or T) has a single occurrence in the genome. For the S. pyogenes Cas9, a unique target sequence in a genome may include a Cas9 target site of the form MMMMMM-MMNNNNNNNNNNNXGGXG (SEQ ID NO: 26) where NNNNNNNNNNNXGGXG (SEQ ID NO: 27) (N is A, G, T, or C; and X can be anything) has a single occurrence in the genome. A unique target sequence in a genome may include an S. pyogenes Cas9 target site of the form MMM-MMMMMMNNNNNNNNNNNXGGXG (SEQ ID NO: 28) where NNNNNNNNNNNXGGXG (SEQ ID NO: 29) (N is A, G, T, or C; and X can be anything) has a single occurrence in the genome. In each of these sequences "M" may be A, G, T, or C, and need not be considered in identifying a sequence as unique.

In some embodiments, a guide sequence is selected to reduce the degree of secondary structure within the guide sequence. Secondary structure may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g. A. R. Gruber et al., 2008, *Cell* 106(1): 23-24; and PA Carr and GM Church, 2009, *Nature Biotechnology* 27(12): 1151-62). Further algorithms may be found in U.S. application Ser. No. 61/836,080; incorporated herein by reference.

In general, a tracr mate sequence includes any sequence that has sufficient complementarity with a tracr sequence to promote one or more of: (1) excision of a guide sequence flanked by tracr mate sequences in a cell containing the corresponding tracr sequence; and (2) formation of a CRISPR complex at a target sequence, wherein the CRISPR complex comprises the tracr mate sequence hybridized to the tracr sequence. In general, degree of complementarity is with reference to the optimal alignment of the tracr mate sequence and tracr sequence, along the length of the shorter of the two sequences. Optimal alignment may be determined by any suitable alignment algorithm, and may further account for secondary structures, such as self-complementarity within either the tracr sequence or tracr mate sequence. In some embodiments, the degree of complementarity between the tracr sequence and tracr mate sequence along the length of the shorter of the two when optimally aligned is about or more than about 25%, 30%, 40%, 50%, 60%, 70%, 80%, 90%, 95%, 97.5%, 99%, or higher. Example illustrations of optimal alignment between a tracr sequence and a tracr mate sequence are provided in FIGS. 10B and 11B. In some embodiments, the tracr sequence is about or more than about 5, 6, 7, 8, 9, 10, 11, 12, 13, 14, 15, 16, 17, 18, 19, 20, 25, 30, 40, 50, or more nucleotides in length. In some embodiments, the tracr sequence and tracr mate sequence are contained within a single transcript, such that hybridization between the two produces a transcript having a secondary structure, such as a hairpin. Preferred loop forming sequences for use in hairpin structures are four nucleotides in length, and most preferably have the sequence GAAA. However, longer or shorter loop sequences may be used, as may alternative sequences. The sequences preferably include a nucleotide triplet (for example, AAA), and an additional nucleotide (for example C or G). Examples of loop forming sequences include CAAA and AAAG. In an embodiment of the invention, the transcript or transcribed polynucleotide sequence has at least two or more hairpins. In preferred embodiments, the transcript has two, three, four or five hairpins. In a further embodiment of the invention, the transcript has at most five hairpins. In some embodiments, the single transcript further includes a transcription termination sequence; preferably this is a polyT sequence, for example six T nucleotides. An example illustration of such a hairpin structure is provided in the lower portion of FIG. 11B, where the portion of the sequence 5' of the final "N" and upstream of the loop corresponds to the tracr mate sequence, and the portion of the sequence 3' of the loop corresponds to the tracr sequence. Further non-limiting examples of single polynucleotides comprising a guide sequence, a tracr mate sequence, and a tracr sequence are as follows (listed 5' to 3'), where "N" represents a base of a guide sequence, the first block of lower case letters represent the tracr mate sequence, and the second block of lower case letters represent the tracr sequence, and the final poly-T sequence represents the transcription terminator: (1) NNNNNNNNNN NNNNNNNNNN gttttgtact ctcaagattt aGAAAtaaat cttgcagaag ctacaaagat aaggcttcat gccgaaatca acaccctgtc attttatggc agggtgtttt cgttatttaa TTTTTT (SEQ ID NO: 30); (2) NNNNNNNNNN NNNNNNNNNN gttttgtac tctcaGAAAt gcagaagcta caaagataag gcttcatgcc gaaatcaaca ccctgtcatt ttatggcagg gtgttttcgt tatttaaTTT TTT (SEQ ID NO: 31); (3) NNNNNNNNNN NNNNNNNNNN gttttgtac tctcaGAAAt gcagaagcta caaagataag gcttcatgcc gaaatcaaca ccctgtcatt ttatggcagg gtgtTTTTTT (SEQ ID NO: 32); (4) NNNNNNNNNN NNNNNNNNNN gttttagagc taGAAAtagc aagttaaaat aaggctagtc cgttatcaac ttgaaaaagt ggcaccgagt cggtgcTTTT TT (SEQ ID NO: 33); (5) NNNNNNNNNN NNNNNNNNNN gttttagagc taGAAATAGc aagttaaaat aaggctagtc cgttatcaac ttgaaaaagt gTTTTTTT (SEQ ID NO: 34); and (6) NNNNNNNNNN NNNNNNNNNN gttttagagc tagAAATAGc aagttaaaat aaggctagtc cgttatcaTT TTTTTT (SEQ ID NO: 35). In some embodiments, sequences (1) to (3) are used in combination with Cas9 from *S. thermophilus* CRISPR1. In some embodiments, sequences (4) to (6) are used in combination with Cas9 from *S. pyogenes*. In some embodiments, the tracr sequence is a separate transcript from a transcript comprising the tracr mate sequence (such as illustrated in the top portion of FIG. 11B).

In some embodiments, the CRISPR enzyme is part of a fusion protein comprising one or more heterologous protein domains (e.g. about or more than about 1, 2, 3, 4, 5, 6, 7, 8, 9, 10, or more domains in addition to the CRISPR enzyme). A CRISPR enzyme fusion protein may comprise any additional protein sequence, and optionally a linker sequence between any two domains. Examples of protein domains that may be fused to a CRISPR enzyme include, without limitation, epitope tags, reporter gene sequences, and protein domains having one or more of the following activities: methylase activity, demethylase activity, transcription activation activity, transcription repression activity, transcription release factor activity, histone modification activity, RNA cleavage activity and nucleic acid binding activity. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). A CRISPR enzyme may be fused to a gene sequence encoding a protein or a fragment of a protein that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions. Additional domains that may form part of a fusion protein comprising a CRISPR enzyme are described in US20110059502, incorporated herein by reference. In some embodiments, a tagged CRISPR enzyme is used to identify the location of a target sequence.

In an aspect of the invention, a reporter gene which includes but is not limited to glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP), may be introduced into a cell to encode a gene product which serves as a marker by which to measure the alteration or modification of expression of the gene product. In a further embodiment of the invention, the DNA molecule encoding the gene product may be introduced into the cell via a vector. In a preferred embodiment of the invention the gene product is luciferase. In a further embodiment of the invention the expression of the gene product is decreased.

In some aspects, the invention provides methods comprising delivering one or more polynucleotides, such as or one or more vectors as described herein, one or more transcripts thereof, and/or one or proteins transcribed therefrom, to a host cell. In some aspects, the invention further provides cells produced by such methods, and organisms (such as animals, plants, or fungi) comprising or produced from such cells. In some embodiments, a CRISPR enzyme in combination with (and optionally complexed with) a guide sequence is delivered to a cell. Conventional viral and non-viral based gene transfer methods can be used to introduce nucleic acids in mammalian cells or target tissues. Such methods can be used to administer nucleic acids encoding components of a CRISPR system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, Nature 357:455-460 (1992); Van Brunt, Biotechnology 6(10):1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology Doerfler and Bohm (eds) (1995); and Yu et al., Gene Therapy 1:13-26 (1994).

Methods of non-viral delivery of nucleic acids include lipofection, nucleofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, WO 91/17424; WO 91/16024. Delivery can be to cells (e.g. in vitro or ex vivo administration) or target tissues (e.g. in vivo administration).

The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

The use of RNA or DNA viral based systems for the delivery of nucleic acids take advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700). In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

Packaging cells are typically used to form virus particles that are capable of infecting a host cell. Such cells include 293 cells, which package adenovirus, and w2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA is packaged in a cell line, which contains a helper plasmid encoding the other AAV genes, namely rep and cap, but lacking ITR sequences. The cell line may also be infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additional methods for the delivery of nucleic acids to cells are known to those skilled in the art. See, for example, US20030087817, incorporated herein by reference.

In some embodiments, a host cell is transiently or non-transiently transfected with one or more vectors described herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, C1R, Rath, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRCS, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-1 cells, BEAS-2B, bEnd.3, BHK-21, BR 293, BxPC3, C3H-10T1/2, C6/36, Cal-27, CHO, CHO-7, CHO-IR, CHO-K1, CHO-K2, CHO-T, CHO Dhfr−/−, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepa1c1c7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK II, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)). In some embodiments, a cell transfected with one or more vectors described herein is used to establish a new cell line comprising one or more vector-derived sequences. In some embodiments, a cell transiently transfected with the components of a CRISPR system as described herein (such as by transient transfection of one or more vectors, or transfection with RNA), and modified through the activity of a CRISPR complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

In some embodiments, one or more vectors described herein are used to produce a non-human transgenic animal or transgenic plant. In some embodiments, the transgenic animal is a mammal, such as a mouse, rat, or rabbit. In certain embodiments, the organism or subject is a plant. In certain embodiments, the organism or subject or plant is algae. Methods for producing transgenic plants and animals are known in the art, and generally begin with a method of cell transfection, such as described herein. Transgenic animals are also provided, as are transgenic plants, especially crops and algae. The transgenic animal or plant may be useful in applications outside of providing a disease model. These may include food or feed production through expression of, for instance, higher protein, carbohydrate, nutrient or vitamins levels than would normally be seen in the wildtype. In this regard, transgenic plants, especially pulses and tubers, and animals, especially mammals such as livestock (cows, sheep, goats and pigs), but also poultry and edible insects, are preferred.

Transgenic algae or other plants such as rape may be particularly useful in the production of vegetable oils or biofuels such as alcohols (especially methanol and ethanol), for instance. These may be engineered to express or over-express high levels of oil or alcohols for use in the oil or biofuel industries.

In one aspect, the invention provides for methods of modifying a target polynucleotide in a eukaryotic cell, which may be in vivo, ex vivo or in vitro. In some embodiments, the method comprises sampling a cell or population of cells from a human or non-human animal or plant (including micro-algae), and modifying the cell or cells. Culturing may occur at any stage ex vivo. The cell or cells may even be re-introduced into the non-human animal or plant (including micro-algae).

In one aspect, the invention provides for methods of modifying a target polynucleotide in a eukaryotic cell. In some embodiments, the method comprises allowing a CRISPR complex to bind to the target polynucleotide to effect cleavage of said target polynucleotide thereby modifying the target polynucleotide, wherein the CRISPR complex comprises a CRISPR enzyme complexed with a guide sequence hybridized to a target sequence within said target polynucleotide, wherein said guide sequence is linked to a tracr mate sequence which in turn hybridizes to a tracr sequence.

In one aspect, the invention provides a method of modifying expression of a polynucleotide in a eukaryotic cell. In some embodiments, the method comprises allowing a CRISPR complex to bind to the polynucleotide such that said binding results in increased or decreased expression of said polynucleotide; wherein the CRISPR complex comprises a CRISPR enzyme complexed with a guide sequence hybridized to a target sequence within said polynucleotide, wherein said guide sequence is linked to a tracr mate sequence which in turn hybridizes to a tracr sequence.

With recent advances in crop genomics, the ability to use CRISPR-Cas systems to perform efficient and cost effective gene editing and manipulation will allow the rapid selection and comparison of single and multiplexed genetic manipulations to transform such genomes for improved production and enhanced traits. In this regard reference is made to US patents and publications: U.S. Pat. No. 6,603,061—*Agrobacterium*-Mediated Plant Transformation Method; U.S. Pat. No. 7,868,149—Plant Genome Sequences and Uses Thereof and US 2009/0100536—Transgenic Plants with Enhanced Agronomic Traits, all the contents and disclosure of each of which are herein incorporated by reference in their entirety. In the practice of the invention, the contents and disclosure of Morrell et al "Crop genomics: advances and applications" Nat Rev Genet. 2011 Dec. 29; 13(2):85-96 are also herein incorporated by reference in their entirety. In an advantageous embodiment of the invention, the CRISPR/Cas9 system is used to engineer microalgae. That the CRISPR-Cas system is able to be employed in plant systems is also provided in the manuscript "Efficient Genome Editing in Plants using a CRISPR/Cas System", by Feng et al. Cell Res. 2013 Aug. 20. doi: 10.1038/cr.2013.114. [Epub ahead of print], incorporated by reference in its entirety, wherein it is demonstrated that engineered CRISPR/Cas complexes may be used to create double strand breaks at specific sites of the plant genome to achieve targeted genome modifications in both dicot and monocot plants. Accordingly, reference herein to animal cells may also apply, mutatis mutandis, to plant cells unless otherwise apparent.

In plants, pathogens are often host-specific. For example, *Fusarium oxysporum* f sp. *lycopersici* causes tomato wilt but attacks only tomato, and *F. oxysporum* f. *dianthii Puccinia graminis* f sp. *tritici* attacks only wheat. Plants have existing and induced defenses to resist most pathogens. Mutations and recombination events across plant generations lead to genetic variability that gives rise to susceptibility, especially as pathogens reproduce with more frequency than plants. In plants there can be non-host resistance, e.g., the host and pathogen are incompatible. There can also be Horizontal Resistance, e.g., partial resistance against all races of a pathogen, typically controlled by many genes and Vertical Resistance, e.g., complete resistance to some races of a pathogen but not to other races, typically controlled by a few genes. In a Gene-for-Gene level, plants and pathogens evolve together, and the genetic changes in one balance changes in other. Accordingly, using Natural Variability, breeders combine most useful genes for Yield, Quality, Uniformity, Hardiness, Resistance. The sources of resistance genes include native or foreign Varieties, Heirloom Varieties, Wild Plant Relatives, and Induced Mutations, e.g., treating plant material with mutagenic agents. Using the present invention, plant breeders are provided with a new tool to induce mutations. Accordingly, one skilled in the art can analyze the genome of sources of resistance genes, and in Varieties having desired characteristics or traits employ the present invention to induce the rise of resistance genes, with more precision than previous mutagenic agents and hence accelerate and improve plant breeding programs.

In one aspect, the invention provides kits containing any one or more of the elements disclosed in the above methods and compositions. In some embodiments, the kit comprises a vector system and instructions for using the kit. In some embodiments, the vector system comprises (a) a first regulatory element operably linked to a tracr mate sequence and one or more insertion sites for inserting a guide sequence upstream of the tracr mate sequence, wherein when expressed, the guide sequence directs sequence-specific binding of a CRISPR complex to a target sequence in a eukaryotic cell, wherein the CRISPR complex comprises a CRISPR enzyme complexed with (1) the guide sequence that is hybridized to the target sequence, and (2) the tracr mate sequence that is hybridized to the tracr sequence; and/or (b) a second regulatory element operably linked to an enzyme-coding sequence encoding said CRISPR enzyme comprising a nuclear localization sequence. Elements may be provided individually or in combinations, and may be provided in any suitable container, such as a vial, a bottle, or a tube. In some embodiments, the kit includes instructions in one or more languages, for example in more than one language.

In some embodiments, a kit comprises one or more reagents for use in a process utilizing one or more of the elements described herein. Reagents may be provided in any suitable container. For example, a kit may provide one or more reaction or storage buffers. Reagents may be provided in a form that is usable in a particular assay, or in a form that requires addition of one or more other components before use (e.g. in concentrate or lyophilized form). A buffer can be any buffer, including but not limited to a sodium carbonate buffer, a sodium bicarbonate buffer, a borate buffer, a Tris buffer, a MOPS buffer, a HEPES buffer, and combinations thereof. In some embodiments, the buffer is alkaline. In some embodiments, the buffer has a pH from about 7 to about 10. In some embodiments, the kit comprises one or more oligonucleotides corresponding to a guide sequence for insertion into a vector so as to operably link the guide sequence and a regulatory element. In some embodiments, the kit comprises a homologous recombination template polynucleotide.

In one aspect, the invention provides methods for using one or more elements of a CRISPR system. The CRISPR complex of the invention provides an effective means for modifying a target polynucleotide. The CRISPR complex of the invention has a wide variety of utility including modifying (e.g., deleting, inserting, translocating, inactivating, activating) a target polynucleotide in a multiplicity of cell types. As such the CRISPR complex of the invention has a broad spectrum of applications in, e.g., gene therapy, drug screening, disease diagnosis, and prognosis. An exemplary CRISPR complex comprises a CRISPR enzyme complexed with a guide sequence hybridized to a target sequence within the target polynucleotide. The guide sequence is linked to a tracr mate sequence, which in turn hybridizes to a tracr sequence.

The target polynucleotide of a CRISPR complex can be any polynucleotide endogenous or exogenous to the eukaryotic cell. For example, the target polynucleotide can be a polynucleotide residing in the nucleus of the eukaryotic cell. The target polynucleotide can be a sequence coding a gene product (e.g., a protein) or a non-coding sequence (e.g., a regulatory polynucleotide or a junk DNA). The target can be a control element or a regulatory element or a promoter or an enhancer or a silencer. The promoter may, in some embodiments, be in the region of +200 bp or even +1000 bp from the TTS. In some embodiments, the regulatory region may be an enhancer. The enhancer is typically more than +1000 bp from the TTS. More in particular, expression of eukaryotic protein-coding genes generally is regulated through multiple cis-acting transcription-control regions. Some control elements are located close to the start site (promoter-proximal elements), whereas others lie more distant (enhancers and silencers) Promoters determine the site of transcription initiation and direct binding of RNA polymerase II. Three types of promoter sequences have been identified in eukaryotic DNA. The TATA box, the most common, is prevalent in rapidly transcribed genes. Initiator promoters infrequently are found in some genes, and CpG islands are characteristic of transcribed genes. Promoter-proximal elements occur within about 200 base pairs of the start site. Several such elements, containing up to about 20 base pairs, may help regulate a particular gene. Enhancers, which are usually about 100-200 base pairs in length, contain multiple 8- to 20-bp control elements. They may be located from 200 base pairs to tens of kilobases upstream or downstream from a promoter, within an intron, or downstream from the final exon of a gene. Promoter-proximal elements and enhancers may be cell-type specific, functioning only in specific differentiated cell types. However, any of these regions can be the target sequence and are encompassed by the concept that the target can be a control element or a regulatory element or a promoter or an enhancer or a silencer.

Without wishing to be bound by theory, it is believed that the target sequence should be associated with a PAM (protospacer adjacent motif); that is, a short sequence recognized by the CRISPR complex. The precise sequence and length requirements for the PAM differ depending on the CRISPR enzyme used, but PAMs are typically 2-5 base pair sequences adjacent the protospacer (that is, the target sequence) Examples of PAM sequences are given in the examples section below, and the skilled person will be able to identify further PAM sequences for use with a given CRISPR enzyme.

The target polynucleotide of a CRISPR complex may include a number of disease-associated genes and polynucleotides as well as signaling biochemical pathway-associated genes and polynucleotides as listed in U.S. provisional patent applications 61/736,527 and 61/748,427, both entitled SYSTEMS METHODS AND COMPOSITIONS FOR SEQUENCE MANIPULATION filed on Dec. 12, 2012 and Jan. 2, 2013, respectively, the contents of all of which are herein incorporated by reference in their entirety.

Examples of target polynucleotides include a sequence associated with a signaling biochemical pathway, e.g., a signaling biochemical pathway-associated gene or polynucleotide. Examples of target polynucleotides include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease. The transcribed or translated products may be known or unknown, and may be at a normal or abnormal level.

Examples of disease-associated genes and polynucleotides are available from McKusick-Nathans Institute of Genetic Medicine, Johns Hopkins University (Baltimore, Md.) and National Center for Biotechnology Information, National Library of Medicine (Bethesda, Md.), available on the World Wide Web.

Examples of disease-associated genes and polynucleotides are listed in Tables A and B. Disease specific information is available from McKusick-Nathans Institute of Genetic Medicine, Johns Hopkins University (Baltimore, Md.) and National Center for Biotechnology Information, National Library of Medicine (Bethesda, Md.), available on the World Wide Web. Examples of signaling biochemical pathway-associated genes and polynucleotides are listed in Table C.

Mutations in these genes and pathways can result in production of improper proteins or proteins in improper amounts which affect function. Further examples of genes, diseases and proteins are hereby incorporated by reference from US Provisional application. Such genes, proteins and pathways may be the target polynucleotide of a CRISPR complex.

TABLE A

| DISEASE/DISORDERS | GENE(S) |
| --- | --- |
| Neoplasia | PTEN; ATM; ATR; EGFR; ERBB2; ERBB3; ERBB4; Notch1; Notch2; Notch3; Notch4; AKT; AKT2; AKT3; HIF; HIF1a; HIF3a; Met; HRG; Bcl2; PPAR alpha; PPAR gamma; WT1 (Wilms Tumor); FGF Receptor Family members (5 members: 1, 2, 3, 4, 5); CDKN2a; APC; RB (retinoblastoma); MEN1; VHL; BRCA1; BRCA2; AR (Androgen Receptor); TSG101; IGF; IGF Receptor; Igf1 (4 variants); Igf2 (3 variants); Igf 1 Receptor; Igf 2 Receptor; Bax; Bcl2; caspases family (9 members: 1, 2, 3, 4, 6, 7, 8, 9, 12); Kras; Apc |
| Age-related Macular Degeneration | Abcr; Ccl2; Cc2; cp (ceruloplasmin); Timp3; cathepsinD; Vldlr; Ccr2 |
| Schizophrenia | Neuregulin1 (Nrg1); Erb4 (receptor for Neuregulin); Complexin1 (Cplx1); Tph1 Tryptophan hydroxylase; Tph2 Tryptophan hydroxylase 2; Neurexin 1; GSK3; GSK3a; GSK3b |
| Disorders | 5-HTT (Slc6a4); COMT; DRD (Drd1a); SLC6A3; DAOA; DTNBP1; Dao (Dao1) |
| Trinucleotide Repeat Disorders | HTT (Huntington's Dx); SBMA/SMAX1/AR (Kennedy's Dx); FXN/X25 (Friedrich's Ataxia); ATX3 (Machado-Joseph's Dx); ATXN1 and ATXN2 (spinocerebellar ataxias); DMPK (myotonic dystrophy); Atrophin-1 and Atn1 (DRPLA Dx); CBP (Creb-BP - global instability); VLDLR (Alzheimer's); Atxn7; Atxn10 |
| Fragile X Syndrome | FMR2; FXR1; FXR2; mGLUR5 |
| Secretase Related Disorders | APH-1 (alpha and beta); Presenilin (Psen1); nicastrin (Ncstn); PEN-2 |
| Others | Nos1; Parp1; Nat1; Nat2 |
| Prion - related disorders | Prp |
| ALS | SOD1; ALS2; STEX; FUS; TARDBP; VEGF (VEGF-a; VEGF-b; VEGF-c) |
| Drug addiction | Prkce (alcohol); Drd2; Drd4; ABAT (alcohol); GRIA2; Grm5; Grin1; Htr1b; Grin2a; Drd3; Pdyn; Gria1 (alcohol) |
| Autism | Mecp2; BZRAP1; MDGA2; Sema5A; Neurexin 1; Fragile X (FMR2 (AFF2); FXR1; FXR2; Mglur5) |
| Alzheimer's Disease | E1; CHIP; UCH; UBB; Tau; LRP; PICALM; Clusterin; PS1; SORL1; CR1; Vldlr; Uba1; Uba3; CHIP28 (Aqp1, Aquaporin 1); Uchl1; Uchl3; APP |
| Inflammation | IL-10; IL-1 (IL-1a; IL-1b); IL-13; IL-17 (IL-17a (CTLA8); IL-17b; IL-17c; IL-17d; IL-17f); II-23; Cx3cr1; ptpn22; TNFa; NOD2/CARD15 for IBD; IL-6; IL-12 (IL-12a; IL-12b); CTLA4; Cx3cl1 |
| Parkinson's Disease | x-Synuclein; DJ-1; LRRK2; Parkin; PINK1 |

TABLE B

| Blood and coagulation diseases and disorders | Anemia (CDAN1, CDA1, RPS19, DBA, PKLR, PK1, NT5C3, UMPH1, PSN1, RHAG, RH50A, NRAMP2, SPTB, ALAS2, ANH1, ASB, ABCB7, ABC7, ASAT); Bare lymphocyte syndrome (TAPBP, TPSN, TAP2, ABCB3, PSF2, RING11, MHC2TA, C2TA, RFX5, RFXAP, RFX5), Bleeding disorders (TBXA2R, P2RX1, P2X1); Factor H and factor H-like 1 (HF1, CFH, HUS); Factor V and factor VIII (MCFD2); Factor VII deficiency (F7); Factor X deficiency (F10); Factor XI deficiency (F11); Factor XII deficiency (F12, HAF); Factor XIIIA deficiency (F13A1, F13A); Factor XIIIB deficiency (F13B); Fanconi anemia (FANCA, FACA, FA1, FA, FAA, FAAP95, FAAP90, FLJ34064, FANCB, FANCC, FACC, BRCA2, FANCD1, FANCD2, FANCD, FACD, FAD, FANCE, FACE, FANCF, XRCC9, FANCG, BRIP1, BACH1, FANCJ, PHF9, FANCL, FANCM, KIAA1596); Hemophagocytic lymphohistiocytosis disorders (PRF1, HPLH2, UNC13D, MUNC13-4, HPLH3, HLH3, FHL3); Hemophilia A (F8, F8C, HEMA); Hemophilia B (F9, HEMB), Hemorrhagic disorders (PI, ATT, F5); Leukocyde deficiencies and disorders (ITGB2, CD18, LCAMB, LAD, EIF2B1, EIF2BA, EIF2B2, EIF2B3, EIF2B5, LVWM, CACH, CLE, EIF2B4); Sickle cell anemia (HBB); Thalassemia (HBA2, HBB, HBD, LCRB, HBA1). |

TABLE B-continued

| | |
|---|---|
| Cell dysregulation and oncology diseases and disorders | B-cell non-Hodgkin lymphoma (BCL7A, BCL7); Leukemia (TAL1, TCL5, SCL, TAL2, FLT3, NBS1, NBS, ZNFN1A1, IK1, LYF1, HOXD4, HOX4B, BCR, CML, PHL, ALL, ARNT, KRAS2, RASK2, GMPS, AF10, ARHGEF12, LARG, KIAA0382, CALM, CLTH, CEBPA, CEBP, CHIC2, BTL, FLT3, KIT, PBT, LPP, NPM1, NUP214, D9S46E, CAN, CAIN, RUNX1, CBFA2, AML1, WHSC1L1, NSD3, FLT3, AF1Q, NPM1, NUMA1, ZNF145, PLZF, PML, MYL, STAT5B, AF10, CALM, CLTH, ARL11, ARLTS1, P2RX7, P2X7, BCR, CML, PHL, ALL, GRAF, NF1, VRNF, WSS, NFNS, PTPN11, PTP2C, SHP2, NS1, BCL2, CCND1, PRAD1, BCL1, TCRA, GATA1, GF1, ERYF1, NFE1, ABL1, NQO1, DIA4, NMOR1, NUP214, D9S46E, CAN, CAIN). |
| Inflammation and immune related diseases and disorders | AIDS (KIR3DL1, NKAT3, NKB1, AMB11, KIR3DS1, IFNG, CXCL12, SDF1); Autoimmune lymphoproliferative syndrome (TNFRSF6, APT1, FAS, CD95, ALPS1A); Combined immunodeficiency, (IL2RG, SCIDX1, SCIDX, IMD4); HIV-1 (CCL5, SCYA5, D17S136E, TCP228), HIV susceptibility or infection (IL10, CSIF, CMKBR2, CCR2, CMKBR5, CCCKR5 (CCR5)); Immunodeficiencies (CD3E, CD3G, AICDA, AID, HIGM2, TNFRSF5, CD40, UNG, DGU, HIGM4, TNFSF5, CD40LG, HIGM1, IGM, FOXP3, IPEX, AIID, XPID, PIDX, TNFRSF14B, TACI); Inflammation (IL-10, IL-1 (IL-1a, IL-1b), IL-13, IL-17 (IL-17a (CTLA8), IL-17b, IL-17c, IL-17d, IL-17f), II-23, Cx3cr1, ptpn22, TNFa, NOD2/CARD15 for IBD, IL-6, IL-12 (IL-12a, IL-12b), CTLA4, Cx3cl1); Severe combined immunodeficiencies (SCIDs)(JAK3, JAKL, DCLRE1C, ARTEMIS, SCIDA, RAG1, RAG2, ADA, PTPRC, CD45, LCA, IL7R, CD3D, T3D, IL2RG, SCIDX1, SCIDX, IMD4). |
| Metabolic, liver, kidney and protein diseases and disorders | Amyloid neuropathy (TTR, PALB); Amyloidosis (APOA1, APP, AAA, CVAP, AD1, GSN, FGA, LYZ, TTR, PALB); Cirrhosis (KRT18, KRT8, CIRH1A, NAIC, TEX292, KIAA1988); Cystic fibrosis (CFTR, ABCC7, CF, MRP7); Glycogen storage diseases (SLC2A2, GLUT2, G6PC, G6PT, G6PT1, GAA, LAMP2, LAMPB, AGL, GDE, GBE1, GYS2, PYGL, PFKM); Hepatic adenoma, 142330 (TCF1, HNF1A, MODY3), Hepatic failure, early onset, and neurologic disorder (SCOD1, SCO1), Hepatic lipase deficiency (LIPC), Hepatoblastoma, cancer and carcinomas (CTNNB1, PDGFRL, PDGRL, PRLTS, AXIN1, AXIN, CTNNB1, TP53, P53, LFS1, IGF2R, MPRI, MET, CASP8, MCH5; Medullary cystic kidney disease (UMOD, HNFJ, FJHN, MCKD2, ADMCKD2); Phenylketonuria (PAH, PKU1, QDPR, DHPR, PTS); Polycystic kidney and hepatic disease (FCYT, PKHD1, ARPKD, PKD1, PKD2, PKD4, PKDTS, PRKCSH, G19P1, PCLD, SEC63). |
| Muscular/Skeletal diseases and disorders | Becker muscular dystrophy (DMD, BMD, MYF6), Duchenne Muscular Dystrophy (DMD, BMD); Emery-Dreifuss muscular dystrophy (LMNA, LMN1, EMD2, FPLD, CMD1A, HGPS, LGMD1B, LMNA, LMN1, EMD2, FPLD, CMD1A); Facioscapulohumeral muscular dystrophy (FSHMD1A, FSHD1A); Muscular dystrophy (FKRP, MDC1C, LGMD2I, LAMA2, LAMM, LARGE, KIAA0609, MDC1D, FCMD, TTID, MYOT, CAPN3, CANP3, DYSF, LGMD2B, SGCG, LGMD2C, DMDA1, SCG3, SGCA, ADL, DAG2, LGMD2D, DMDA2, SGCB, LGMD2E, SGCD, SGD, LGMD2F, CMD1L, TCAP, LGMD2G, CMD1N, TRIM32, HT2A, LGMD2H, FKRP, MDC1C, LGMD2I, TTN, CMD1G, TMD, LGMD2J, POMT1, CAV3, LGMD1C, SEPN1, SELN, RSMD1, PLEC1, PLTN, EBS1); Osteopetrosis (LRP5, BMND1, LRP7, LR3, OPPG, VBCH2, CLCN7, CLC7, OPTA2, OSTM1, GL, TCIRG1, TIRC7, OC116, OPTB1); Muscular atrophy (VAPB, VAPC, ALS8, SMN1, SMA1, SMA2, SMA3, SMA4, BSCL2, SPG17, GARS, SMAD1, CMT2D, HEXB, IGHMBP2, SMUBP2, CATF1, SMARD1). |
| Neurological and neuronal diseases and disorders | ALS (SOD1, ALS2, STEX, FUS, TARDBP, VEGF (VEGF-a, VEGF-b, VEGF-c); Alzheimer disease (APP, AAA, CVAP, AD1, APOE, AD2, PSEN2, AD4, STM2, APBB2, FE65L1, NOS3, PLAU, URK, ACE, DCP1, ACE1, MPO, PACIP1, PAXIP1L, PTIP, A2M, BLMH, BMH, PSEN1, AD3); Autism (Mecp2, BZRAP1, MDGA2, Sema5A, Neurexin1, GLO1, MECP2, RTT, PPMX, MRX16, MRX79, NLGN3, NLGN4, KIAA1260, AUTSX2); Fragile X Syndrome (FMR2, FXR1, FXR2, mGLUR5); Huntington's disease and disease like disorders (HD, IT15, PRNP, PRIP, JPH3, JP3, HDL2, TBP, SCA17); Parkinson disease (NR4A2, NURR1, NOT, TINUR, SNCAIP, TBP, SCA17, SNCA, NACP, PARK1, PARK4, DJ1, PARK7, LRRK2, PARK8, PINK1, PARK6, UCHL1, PARK5, SNCA, NACP, PARK1, PARK4, PRKN, PARK2, PDJ, DBH, NDUFV2); Rett syndrome (MECP2, RTT, PPMX, MRX16, MRX79, CDKL5, STK9, MECP2, RTT, PPMX, MRX16, MRX79, x-Synuclein, DJ-1); Schizophrenia (Neuregulin1 (Nrg1), Erb4 (receptor for Neuregulin), Complexin1 (Cplx1), Tph1 Tryptophan hydroxylase, Tph2, Tryptophan hydroxylase 2, Neurexin 1, GSK3, GSK3a, GSK3b, 5-HTT (Slc6a4), COMT, DRD (Drd1a), SLC6A3, DAOA, DTNBP1, Dao (Dao1)); Secretase Related Disorders (APH-1 (alpha and beta), Presenilin (Psen1), nicastrin, (Ncstn), PEN-2, Nos1, Parp1, Nat1, Nat2); Trinucleotide Repeat Disorders (HTT (Huntington's Dx), SBMA/SMAX1/AR (Kennedy's Dx), FXN/X25 (Friedrich's Ataxia), ATX3 (Machado-Joseph's Dx), ATXN1 and ATXN2 (spinocerebellar ataxias), DMPK (myotonic dystrophy), Atrophin-1 and |

TABLE B-continued

| | |
|---|---|
| | Atn1 (DRPLA Dx), CBP (Creb-BP-global instability), VLDLR (Alzheimer's), Atxn7, Atxn10). |
| Occular diseases and disorders | Age-related macular degeneration (Abcr, Ccl2, Cc2, cp (ceruloplasmin), Timp3, cathepsinD, Vldlr, Ccr2); Cataract (CRYAA, CRYA1, CRYBB2, CRYB2, PITX3, BFSP2, CP49, CP47, CRYAA, CRYA1, PAX6, AN2, MGDA, CRYBA1, CRYB1, CRYGC, CRYG3, CCL, LIM2, MP19, CRYGD, CRYG4, BFSP2, CP49, CP47, HSF4, CTM, HSF4, CTM, MIP, AQP0, CRYAB, CRYA2, CTPP2, CRYBB1, CRYGD, CRYG4, CRYBB2, CRYB2, CRYGC, CRYG3, CCL, CRYAA, CRYA1, GJA8, CX50, CAE1, GJA3, CX46, CZP3, CAE3, CCM1, CAM, KRIT1); Corneal clouding and dystrophy (APOA1, TGFBI, CSD2, CDGG1, CSD, BIGH3, CDG2, TACSTD2, TROP2, M1S1, VSX1, RINX, PPCD, PPD, KTCN, COL8A2, FECD, PPCD2, PIP5K3, CFD); Cornea plana congenital (KERA, CNA2); Glaucoma (MYOC, TIGR, GLC1A, JOAG, GPOA, OPTN, GLC1E, FIP2, HYPL, NRP, CYP1B1, GLC3A, OPA1, NTG, NPG, CYP1B1, GLC3A); Leber congenital amaurosis (CRB1, RP12, CRX, CORD2, CRD, RPGRIP1, LCA6, CORD9, RPE65, RP20, AIPL1, LCA4, GUCY2D, GUC2D, LCA1, CORD6, RDH12, LCA3); Macular dystrophy (ELOVL4, ADMD, STGD2, STGD3, RDS, RP7, PRPH2, PRPH, AVMD, AOFMD, VMD2). |

TABLE C

| CELLULAR FUNCTION | GENES |
|---|---|
| PI3K/AKT Signaling | PRKCE; ITGAM; ITGA5; IRAK1; PRKAA2; EIF2AK2; PTEN; EIF4E; PRKCZ; GRK6; MAPK1; TSC1; PLK1; AKT2; IKBKB; PIK3CA; CDK8; CDKN1B; NFKB2; BCL2; PIK3CB; PPP2R1A; MAPK8; BCL2L1; MAPK3; TSC2; ITGA1; KRAS; EIF4EBP1; RELA; PRKCD; NOS3; PRKAA1; MAPK9; CDK2; PPP2CA; PIM1; ITGB7; YWHAZ; ILK; TP53; RAF1; IKBKG; RELB; DYRK1A; CDKN1A; ITGB1; MAP2K2; JAK1; AKT1; JAK2; PIK3R1; CHUK; PDPK1; PPP2R5C; CTNNB1; MAP2K1; NFKB1; PAK3; ITGB3; CCND1; GSK3A; FRAP1; SFN; ITGA2; TTK; CSNK1A1; BRAF; GSK3B; AKT3; FOXO1; SGK; HSP90AA1; RPS6KB1 |
| ERK/MAPK Signaling | PRKCE; ITGAM; ITGA5; HSPB1; IRAK1; PRKAA2; EIF2AK2; RAC1; RAP1A; TLN1; EIF4E; ELK1; GRK6; MAPK1; RAC2; PLK1; AKT2; PIK3CA; CDK8; CREB1; PRKCI; PTK2; FOS; RPS6KA4; PIK3CB; PPP2R1A; PIK3C3; MAPK8; MAPK3; ITGA1; ETS1; KRAS; MYCN; EIF4EBP1; PPARG; PRKCD; PRKAA1; MAPK9; SRC; CDK2; PPP2CA; PIM1; PIK3C2A; ITGB7; YWHAZ; PPP1CC; KSR1; PXN; RAF1; FYN; DYRK1A; ITGB1; MAP2K2; PAK4; PIK3R1; STAT3; PPP2R5C; MAP2K1; PAK3; ITGB3; ESR1; ITGA2; MYC; TTK; CSNK1A1; CRKL; BRAF; ATF4; PRKCA; SRF; STAT1; SGK |
| Glucocorticoid Receptor Signaling | RAC1; TAF4B; EP300; SMAD2; TRAF6; PCAF; ELK1; MAPK1; SMAD3; AKT2; IKBKB; NCOR2; UBE2I; PIK3CA; CREB1; FOS; HSPA5; NFKB2; BCL2; MAP3K14; STAT5B; PIK3CB; PIK3C3; MAPK8; BCL2L1; MAPK3; TSC22D3; MAPK10; NRIP1; KRAS; MAPK13; RELA; STAT5A; MAPK9; NOS2A; PBX1; NR3C1; PIK3C2A; CDKN1C; TRAF2; SERPINE1; NCOA3; MAPK14; TNF; RAF1; IKBKG; MAP3K7; CREBBP; CDKN1A; MAP2K2; JAK1; IL8; NCOA2; AKT1; JAK2; PIK3R1; CHUK; STAT3; MAP2K1; NFKB1; TGFBR1; ESR1; SMAD4; CEBPB; JUN; AR; AKT3; CCL2; MMP1; STAT1; IL6; HSP90AA1 |
| Axonal Guidance Signaling | PRKCE; ITGAM; ROCK1; ITGA5; CXCR4; ADAM12; IGF1; RAC1; RAP1A; EIF4E; PRKCZ; NRP1; NTRK2; ARHGEF7; SMO; ROCK2; MAPK1; PGF; RAC2; PTPN11; GNAS; AKT; PIK3CA; ERBB2; PRKCI; PTK2; CFL1; GNAQ; PIK3CB; CXCL12; PIK3C3; WNT11; PRKD1; GNB2L1; ABL1; MAPK3; ITGA1; KRAS; RHOA; PRKCD; PIK3C2A; ITGB7; GLI2; PXN; VASP; RAF1; FYN; ITGB1; MAP2K2; PAK4; ADAM17; AKT1; PIK3R1; GLI1; WNT5A; ADAM10; MAP2K1; PAK3; ITGB3; CDC42; VEGFA; ITGA2; EPHA8; CRKL; RND1; GSK3B; AKT3; PRKCA |
| Ephrin Receptor Signaling | PRKCE; ITGAM; ROCK1; ITGA5; CXCR4; IRAK1; PRKAA2; EIF2AK2; RAC1; RAP1A; GRK6; ROCK2; MAPK1; PGF; RAC2; PTPN11; GNAS; PLK1; AKT2; DOK1; CDK8; CREB1; PTK2; CFL1; GNAQ; MAP3K14; CXCL12; MAPK8; GNB2L1; ABL1; MAPK3; ITGA1; |

TABLE C-continued

| CELLULAR FUNCTION | GENES |
|---|---|
| | KRAS; RHOA; PRKCD; PRKAA1; MAPK9; SRC; CDK2; PIM1; ITGB7; PXN; RAF1; FYN; DYRK1A; ITGB1; MAP2K2; PAK4; AKT1; JAK2; STAT3; ADAM10; MAP2K1; PAK3; ITGB3; CDC42; VEGFA; ITGA2; EPHA8; TTK; CSNK1A1; CRKL; BRAF; PTPN13; ATF4; AKT3; SGK |
| Actin Cytoskeleton Signaling | ACTN4; PRKCE; ITGAM; ROCK1; ITGA5; IRAK1; PRKAA2; EIF2AK2; RAC1; INS; ARHGEF7; GRK6; ROCK2; MAPK1; RAC2; PLK1; AKT2; PIK3CA; CDK8; PTK2; CFL1; PIK3CB; MYH9; DIAPH1; PIK3C3; MAPK8; F2R; MAPK3; SLC9A1; ITGA1; KRAS; RHOA; PRKCD; PRKAA1; MAPK9; CDK2; PIM1; PIK3C2A; ITGB7; PPP1CC; PXN; VIL2; RAF1; GSN; DYRK1A; ITGB1; MAP2K2; PAK4; PIP5K1A; PIK3R1; MAP2K1; PAK3; ITGB3; CDC42; APC; ITGA2; TTK; CSNK1A1; CRKL; BRAF; VAV3; SGK |
| Huntington's Disease Signaling | PRKCE; IGF1; EP300; RCOR1; PRKCZ; HDAC4; TGM2; MAPK1; CAPNS1; AKT2; EGFR; NCOR2; SP1; CAPN2; PIK3CA; HDAC5; CREB1; PRKCI; HSPA5; REST; GNAQ; PIK3CB; PIK3C3; MAPK8; IGF1R; PRKD1; GNB2L1; BCL2L1; CAPN1; MAPK3; CASP8; HDAC2; HDAC7A; PRKCD; HDAC11; MAPK9; HDAC9; PIK3C2A; HDAC3; TP53; CASP9; CREBBP; AKT1; PIK3R1; PDPK1; CASP1; APAF1; FRAP1; CASP2; JUN; BAX; ATF4; AKT3; PRKCA; CLTC; SGK; HDAC6; CASP3 |
| Apoptosis Signaling | PRKCE; ROCK1; BID; IRAK1; PRKAA2; EIF2AK2; BAK1; BIRC4; GRK6; MAPK1; CAPNS1; PLK1; AKT2; IKBKB; CAPN2; CDK8; FAS; NFKB2; BCL2; MAP3K14; MAPK8; BCL2L1; CAPN1; MAPK3; CASP8; KRAS; RELA; PRKCD; PRKAA1; MAPK9; CDK2; PIM1; TP53; TNF; RAF1; IKBKG; RELB; CASP9; DYRK1A; MAP2K2; CHUK; APAF1; MAP2K1; NFKB1; PAK3; LMNA; CASP2; BIRC2; TTK; CSNK1A1; BRAF; BAX; PRKCA; SGK; CASP3; BIRC3; PARP1 |
| B Cell Receptor Signaling | RAC1; PTEN; LYN; ELK1; MAPK1; RAC2; PTPN11; AKT2; IKBKB; PIK3CA; CREB1; SYK; NFKB2; CAMK2A; MAP3K14; PIK3CB; PIK3C3; MAPK8; BCL2L1; ABL1; MAPK3; ETS1; KRAS; MAPK13; RELA; PTPN6; MAPK9; EGR1; PIK3C2A; BTK; MAPK14; RAF1; IKBKG; RELB; MAP3K7; MAP2K2; AKT1; PIK3R1; CHUK; MAP2K1; NFKB1; CDC42; GSK3A; FRAP1; BCL6; BCL10; JUN; GSK3B; ATF4; AKT3; VAV3; RPS6KB1 |
| Leukocyte Extravasation Signaling | ACTN4; CD44; PRKCE; ITGAM; ROCK1; CXCR4; CYBA; RAC1; RAP1A; PRKCZ; ROCK2; RAC2; PTPN11; MMP14; PIK3CA; PRKCI; PTK2; PIK3CB; CXCL12; PIK3C3; MAPK8; PRKD1; ABL1; MAPK10; CYBB; MAPK13; RHOA; PRKCD; MAPK9; SRC; PIK3C2A; BTK; MAPK14; NOX1; PXN; VIL2; VASP; ITGB1; MAP2K2; CTNND1; PIK3R1; CTNNB1; CLDN1; CDC42; F11R; ITK; CRKL; VAV3; CTTN; PRKCA; MMP1; MMP9 |
| Integrin Signaling | ACTN4; ITGAM; ROCK1; ITGA5; RAC1; PTEN; RAP1A; TLN1; ARHGEF7; MAPK1; RAC2; CAPNS1; AKT2; CAPN2; PIK3CA; PTK2; PIK3CB; PIK3C3; MAPK8; CAV1; CAPN1; ABL1; MAPK3; ITGA1; KRAS; RHOA; SRC; PIK3C2A; ITGB7; PPP1CC; ILK; PXN; VASP; RAF1; FYN; ITGB1; MAP2K2; PAK4; AKT1; PIK3R1; TNK2; MAP2K1; PAK3; ITGB3; CDC42; RND3; ITGA2; CRKL; BRAF; GSK3B; AKT3 |
| Acute Phase Response Signaling | IRAK1; SOD2; MYD88; TRAF6; ELK1; MAPK1; PTPN11; AKT2; IKBKB; PIK3CA; FOS; NFKB2; MAP3K14; PIK3CB; MAPK8; RIPK1; MAPK3; IL6ST; KRAS; MAPK13; IL6R; RELA; SOCS1; MAPK9; FTL; NR3C1; TRAF2; SERPINE1; MAPK14; TNF; RAF1; PDK1; IKBKG; RELB; MAP3K7; MAP2K2; AKT1; JAK2; PIK3R1; CHUK; STAT3; MAP2K1; NFKB1; FRAP1; CEBPB; JUN; AKT3; IL1R1; IL6 |
| PTEN Signaling | ITGAM; ITGA5; RAC1; PTEN; PRKCZ; BCL2L11; MAPK1; RAC2; AKT2; EGFR; IKBKB; CBL; PIK3CA; CDKN1B; PTK2; NFKB2; BCL2; PIK3CB; BCL2L1; MAPK3; ITGA1; KRAS; ITGB7; ILK; PDGFRB; INSR; RAF1; IKBKG; CASP9; CDKN1A; ITGB1; MAP2K2; AKT1; PIK3R1; CHUK; PDGFRA; PDPK1; MAP2K1; NFKB1; ITGB3; CDC42; CCND1; GSK3A; ITGA2; GSK3B; AKT3; FOXO1; CASP3; RPS6KB1 |
| p53 Signaling | PTEN; EP300; BBC3; PCAF; FASN; BRCA1; GADD45A; BIRC5; AKT2; PIK3CA; CHEK1; TP53INP1; BCL2; PIK3CB; PIK3C3; MAPK8; THBS1; ATR; BCL2L1; E2F1; |

TABLE C-continued

| CELLULAR FUNCTION | GENES |
|---|---|
| | PMAIP1; CHEK2; TNFRSF10B; TP73; RB1; HDAC9; CDK2; PIK3C2A; MAPK14; TP53; LRDD; CDKN1A; HIPK2; AKT1; PIK3R1; RRM2B; APAF1; CTNNB1; SIRT1; CCND1; PRKDC; ATM; SFN; CDKN2A; JUN; SNAI2; GSK3B; BAX; AKT3 |
| Aryl Hydrocarbon Receptor Signaling | HSPB1; EP300; FASN; TGM2; RXRA; MAPK1; NQO1; NCOR2; SP1; ARNT; CDKN1B; FOS; CHEK1; SMARCA4; NFKB2; MAPK8; ALDH1A1; ATR; E2F1; MAPK3; NRIP1; CHEK2; RELA; TP73; GSTP1; RB1; SRC; CDK2; AHR; NFE2L2; NCOA3; TP53; TNF; CDKN1A; NCOA2; APAF1; NFKB1; CCND1; ATM; ESR1; CDKN2A; MYC; JUN; ESR2; BAX; IL6; CYP1B1; HSP90AA1 |
| Xenobiotic Metabolism Signaling | PRKCE; EP300; PRKCZ; RXRA; MAPK1; NQO1; NCOR2; PIK3CA; ARNT; PRKCI; NFKB2; CAMK2A; PIK3CB; PPP2R1A; PIK3C3; MAPK8; PRKD1; ALDH1A1; MAPK3; NRIP1; KRAS; MAPK13; PRKCD; GSTP1; MAPK9; NOS2A; ABCB1; AHR; PPP2CA; FTL; NFE2L2; PIK3C2A; PPARGC1A; MAPK14; TNF; RAF1; CREBBP; MAP2K2; PIK3R1; PPP2R5C; MAP2K1; NFKB1; KEAP1; PRKCA; EIF2AK3; IL6; CYP1B1; HSP90AA1 |
| SAPK/JNK Signaling | PRKCE; IRAK1; PRKAA2; EIF2AK2; RAC1; ELK1; GRK6; MAPK1; GADD45A; RAC2; PLK1; AKT2; PIK3CA; FADD; CDK8; PIK3CB; PIK3C3; MAPK8; RIPK1; GNB2L1; IRS1; MAPK3; MAPK10; DAXX; KRAS; PRKCD; PRKAA1; MAPK9; CDK2; PIM1; PIK3C2A; TRAF2; TP53; LCK; MAP3K7; DYRK1A; MAP2K2; PIK3R1; MAP2K1; PAK3; CDC42; JUN; TTK; CSNK1A1; CRKL; BRAF; SGK |
| PPAr/RXR Signaling | PRKAA2; EP300; INS; SMAD2; TRAF6; PPARA; FASN; RXRA; MAPK1; SMAD3; GNAS; IKBKB; NCOR2; ABCA1; GNAQ; NFKB2; MAP3K14; STAT5B; MAPK8; IRS1; MAPK3; KRAS; RELA; PRKAA1; PPARGC1A; NCOA3; MAPK14; INSR; RAF1; IKBKG; RELB; MAP3K7; CREBBP; MAP2K2; JAK2; CHUK; MAP2K1; NFKB1; TGFBR1; SMAD4; JUN; IL1R1; PRKCA; IL6; HSP90AA1; ADIPOQ |
| NF-κB Signaling | IRAK1; EIF2AK2; EP300; INS; MYD88; PRKCZ; TRAF6; TBK1; AKT2; EGFR; IKBKB; PIK3CA; BTRC; NFKB2; MAP3K14; PIK3CB; PIK3C3; MAPK8; RIPK1; HDAC2; KRAS; RELA; PIK3C2A; TRAF2; TLR4; PDGFRB; TNF; INSR; LCK; IKBKG; RELB; MAP3K7; CREBBP; AKT1; PIK3R1; CHUK; PDGFRA; NFKB1; TLR2; BCL10; GSK3B; AKT3; TNFAIP3; IL1R1 |
| Neuregulin Signaling | ERBB4; PRKCE; ITGAM; ITGA5; PTEN; PRKCZ; ELK1; MAPK1; PTPN11; AKT2; EGFR; ERBB2; PRKCI; CDKN1B; STAT5B; PRKD1; MAPK3; ITGA1; KRAS; PRKCD; STAT5A; SRC; ITGB7; RAF1; ITGB1; MAP2K2; ADAM17; AKT1; PIK3R1; PDPK1; MAP2K1; ITGB3; EREG; FRAP1; PSEN1; ITGA2; MYC; NRG1; CRKL; AKT3; PRKCA; HSP90AA1; RPS6KB1 |
| Wnt & Beta catenin Signaling | CD44; EP300; LRP6; DVL3; CSNK1E; GJA1; SMO; AKT2; PIN1; CDH1; BTRC; GNAQ; MARK2; PPP2R1A; WNT11; SRC; DKK1; PPP2CA; SOX6; SFRP2; ILK; LEF1; SOX9; TP53; MAP3K7; CREBBP; TCF7L2; AKT1; PPP2R5C; WNT5A; LRP5; CTNNB1; TGFBR1; CCND1; GSK3A; DVL1; APC; CDKN2A; MYC; CSNK1A1; GSK3B; AKT3; SOX2 |
| Insulin Receptor Signaling | PTEN; INS; EIF4E; PTPN1; PRKCZ; MAPK1; TSC1; PTPN11; AKT2; CBL; PIK3CA; PRKCI; PIK3CB; PIK3C3; MAPK8; IRS1; MAPK3; TSC2; KRAS; EIF4EBP1; SLC2A4; PIK3C2A; PPP1CC; INSR; RAF1; FYN; MAP2K2; JAK1; AKT1; JAK2; PIK3R1; PDPK1; MAP2K1; GSK3A; FRAP1; CRKL; GSK3B; AKT3; FOXO1; SGK; RPS6KB1 |
| IL-6 Signaling | HSPB1; TRAF6; MAPKAPK2; ELK1; MAPK1; PTPN11; IKBKB; FOS; NFKB2; MAP3K14; MAPK8; MAPK3; MAPK10; IL6ST; KRAS; MAPK13; IL6R; RELA; SOCS1; MAPK9; ABCB1; TRAF2; MAPK14; TNF; RAF1; IKBKG; RELB; MAP3K7; MAP2K2; IL8; JAK2; CHUK; STAT3; MAP2K1; NFKB1; CEBPB; JUN; IL1R1; SRF; IL6 |
| Hepatic Cholestasis | PRKCE; IRAK1; INS; MYD88; PRKCZ; TRAF6; PPARA; RXRA; IKBKB; PRKCI; NFKB2; MAP3K14; MAPK8; PRKD1; MAPK10; RELA; PRKCD; MAPK9; ABCB1; |

TABLE C-continued

| CELLULAR FUNCTION | GENES |
|---|---|
| | TRAF2; TLR4; TNF; INSR; IKBKG; RELB; MAP3K7; IL8; CHUK; NR1H2; TJP2; NFKB1; ESR1; SREBF1; FGFR4; JUN; IL1R1; PRKCA; IL6 |
| IGF-1 Signaling | IGF1; PRKCZ; ELK1; MAPK1; PTPN11; NEDD4; AKT2; PIK3CA; PRKCI; PTK2; FOS; PIK3CB; PIK3C3; MAPK8; IGF1R; IRS1; MAPK3; IGFBP7; KRAS; PIK3C2A; YWHAZ; PXN; RAF1; CASP9; MAP2K2; AKT1; PIK3R1; PDPK1; MAP2K1; IGFBP2; SFN; JUN; CYR61; AKT3; FOXO1; SRF; CTGF; RPS6KB1 |
| NRF2-mediated Oxidative Stress Response | PRKCE; EP300; SOD2; PRKCZ; MAPK1; SQSTM1; NQO1; PIK3CA; PRKCI; FOS; PIK3CB; PIK3C3; MAPK8; PRKD1; MAPK3; KRAS; PRKCD; GSTP1; MAPK9; FTL; NFE2L2; PIK3C2A; MAPK14; RAF1; MAP3K7; CREBBP; MAP2K2; AKT1; PIK3R1; MAP2K1; PPIB; JUN; KEAP1; GSK3B; ATF4; PRKCA; EIF2AK3; HSP90AA1 |
| Hepatic Fibrosis/Hepatic Stellate Cell Activation | EDN1; IGF1; KDR; FLT1; SMAD2; FGFR1; MET; PGF; SMAD3; EGFR; FAS; CSF1; NFKB2; BCL2; MYH9; IGF1R; IL6R; RELA; TLR4; PDGFRB; TNF; RELB; IL8; PDGFRA; NFKB1; TGFBR1; SMAD4; VEGFA; BAX; IL1R1; CCL2; HGF; MMP1; STAT1; IL6; CTGF; MMP9 |
| PPAR Signaling | EP300; INS; TRAF6; PPARA; RXRA; MAPK1; IKBKB; NCOR2; FOS; NFKB2; MAP3K14; STAT5B; MAPK3; NRIP1; KRAS; PPARG; RELA; STAT5A; TRAF2; PPARGC1A; PDGFRB; TNF; INSR; RAF1; IKBKG; RELB; MAP3K7; CREBBP; MAP2K2; CHUK; PDGFRA; MAP2K1; NFKB1; JUN; IL1R1; HSP90AA1 |
| Fc Epsilon RI Signaling | PRKCE; RAC1; PRKCZ; LYN; MAPK1; RAC2; PTPN11; AKT2; PIK3CA; SYK; PRKCI; PIK3CB; PIK3C3; MAPK8; PRKD1; MAPK3; MAPK10; KRAS; MAPK13; PRKCD; MAPK9; PIK3C2A; BTK; MAPK14; TNF; RAF1; FYN; MAP2K2; AKT1; PIK3R1; PDPK1; MAP2K1; AKT3; VAV3; PRKCA |
| G-Protein Coupled Receptor Signaling | PRKCE; RAP1A; RGS16; MAPK1; GNAS; AKT2; IKBKB; PIK3CA; CREB1; GNAQ; NFKB2; CAMK2A; PIK3CB; PIK3C3; MAPK3; KRAS; RELA; SRC; PIK3C2A; RAF1; IKBKG; RELB; FYN; MAP2K2; AKT1; PIK3R1; CHUK; PDPK1; STAT3; MAP2K1; NFKB1; BRAF; ATF4; AKT3; PRKCA |
| Inositol Phosphate Metabolism | PRKCE; IRAK1; PRKAA2; EIF2AK2; PTEN; GRK6; MAPK1; PLK1; AKT2; PIK3CA; CDK8; PIK3CB; PIK3C3; MAPK8; MAPK3; PRKCD; PRKAA1; MAPK9; CDK2; PIM1; PIK3C2A; DYRK1A; MAP2K2; PIP5K1A; PIK3R1; MAP2K1; PAK3; ATM; TTK; CSNK1A1; BRAF; SGK |
| PDGF Signaling | EIF2AK2; ELK1; ABL2; MAPK1; PIK3CA; FOS; PIK3CB; PIK3C3; MAPK8; CAV1; ABL1; MAPK3; KRAS; SRC; PIK3C2A; PDGFRB; RAF1; MAP2K2; JAK1; JAK2; PIK3R1; PDGFRA; STAT3; SPHK1; MAP2K1; MYC; JUN; CRKL; PRKCA; SRF; STAT1; SPHK2 |
| VEGF Signaling | ACTN4; ROCK1; KDR; FLT1; ROCK2; MAPK1; PGF; AKT2; PIK3CA; ARNT; PTK2; BCL2; PIK3CB; PIK3C3; BCL2L1; MAPK3; KRAS; HIF1A; NOS3; PIK3C2A; PXN; RAF1; MAP2K2; ELAVL1; AKT1; PIK3R1; MAP2K1; SFN; VEGFA; AKT3; FOXO1; PRKCA |
| Natural Killer Cell Signaling | PRKCE; RAC1; PRKCZ; MAPK1; RAC2; PTPN11; KIR2DL3; AKT2; PIK3CA; SYK; PRKCI; PIK3CB; PIK3C3; PRKD1; MAPK3; KRAS; PRKCD; PTPN6; PIK3C2A; LCK; RAF1; FYN; MAP2K2; PAK4; AKT1; PIK3R1; MAP2K1; PAK3; AKT3; VAV3; PRKCA |
| Cell Cycle: G1/S Checkpoint Regulation | HDAC4; SMAD3; SUV39H1; HDAC5; CDKN1B; BTRC; ATR; ABL1; E2F1; HDAC2; HDAC7A; RB1; HDAC11; HDAC9; CDK2; E2F2; HDAC3; TP53; CDKN1A; CCND1; E2F4; ATM; RBL2; SMAD4; CDKN2A; MYC; NRG1; GSK3B; RBL1; HDAC6 |
| T Cell Receptor Signaling | RAC1; ELK1; MAPK1; IKBKB; CBL; PIK3CA; FOS; NFKB2; PIK3CB; PIK3C3; MAPK8; MAPK3; KRAS; RELA; PIK3C2A; BTK; LCK; RAF1; IKBKG; RELB; FYN; MAP2K2; PIK3R1; CHUK; MAP2K1; NFKB1; ITK; BCL10; JUN; VAV3 |
| Death Receptor Signaling | CRADD; HSPB1; BID; BIRC4; TBK1; IKBKB; FADD; FAS; NFKB2; BCL2; MAP3K14; MAPK8; RIPK1; CASP8; DAXX; TNFRSF10B; RELA; TRAF2; TNF; IKBKG; RELB; CASP9; CHUK; APAF1; NFKB1; CASP2; BIRC2; CASP3; BIRC3 |
| FGF Signaling | RAC1; FGFR1; MET; MAPKAPK2; MAPK1; PTPN11; AKT2; PIK3CA; CREB1; PIK3CB; PIK3C3; MAPK8; MAPK3; MAPK13; PTPN6; PIK3C2A; MAPK14; RAF1; |

TABLE C-continued

| CELLULAR FUNCTION | GENES |
|---|---|
| GM-CSF Signaling | AKT1; PIK3R1; STAT3; MAP2K1; FGFR4; CRKL; ATF4; AKT3; PRKCA; HGF LYN; ELK1; MAPK1; PTPN11; AKT2; PIK3CA; CAMK2A; STAT5B; PIK3CB; PIK3C3; GNB2L1; BCL2L1; MAPK3; ETS1; KRAS; RUNX1; PIM1; PIK3C2A; RAF1; MAP2K2; AKT1; JAK2; PIK3R1; STAT3; MAP2K1; CCND1; AKT3; STAT1 |
| Amyotrophic Lateral Sclerosis Signaling | BID; IGF1; RAC1; BIRC4; PGF; CAPNS1; CAPN2; PIK3CA; BCL2; PIK3CB; PIK3C3; BCL2L1; CAPN1; PIK3C2A; TP53; CASP9; PIK3R1; RAB5A; CASP1; APAF1; VEGFA; BIRC2; BAX; AKT3; CASP3; BIRC3 |
| JAK/Stat Signaling | PTPN1; MAPK1; PTPN11; AKT2; PIK3CA; STAT5B; PIK3CB; PIK3C3; MAPK3; KRAS; SOCS1; STAT5A; PTPN6; PIK3C2A; RAF1; CDKN1A; MAP2K2; JAK1; AKT1; JAK2; PIK3R1; STAT3; MAP2K1; FRAP1; AKT3; STAT1 |
| Nicotinate and Nicotinamide Metabolism | PRKCE; IRAK1; PRKAA2; EIF2AK2; GRK6; MAPK1; PLK1; AKT2; CDK8; MAPK8; MAPK3; PRKCD; PRKAA1; PBEF1; MAPK9; CDK2; PIM1; DYRK1A; MAP2K2; MAP2K1; PAK3; NT5E; TTK; CSNK1A1; BRAF; SGK |
| Chemokine Signaling | CXCR4; ROCK2; MAPK1; PTK2; FOS; CFL1; GNAQ; CAMK2A; CXCL12; MAPK8; MAPK3; KRAS; MAPK13; RHOA; CCR3; SRC; PPP1CC; MAPK14; NOX1; RAF1; MAP2K2; MAP2K1; JUN; CCL2; PRKCA |
| IL-2 Signaling | ELK1; MAPK1; PTPN11; AKT2; PIK3CA; SYK; FOS; STAT5B; PIK3CB; PIK3C3; MAPK8; MAPK3; KRAS; SOCS1; STAT5A; PIK3C2A; LCK; RAF1; MAP2K2; JAK1; AKT1; PIK3R1; MAP2K1; JUN; AKT3 |
| Synaptic Long Term Depression | PRKCE; IGF1; PRKCZ; PRDX6; LYN; MAPK1; GNAS; PRKCI; GNAQ; PPP2R1A; IGF1R; PRKD1; MAPK3; KRAS; GRN; PRKCD; NOS3; NOS2A; PPP2CA; YWHAZ; RAF1; MAP2K2; PPP2R5C; MAP2K1; PRKCA |
| Estrogen Receptor Signaling | TAF4B; EP300; CARM1; PCAF; MAPK1; NCOR2; SMARCA4; MAPK3; NRIP1; KRAS; SRC; NR3C1; HDAC3; PPARGC1A; RBM9; NCOA3; RAF1; CREBBP; MAP2K2; NCOA2; MAP2K1; PRKDC; ESR1; ESR2 |
| Protein Ubiquitination Pathway | TRAF6; SMURF1; BIRC4; BRCA1; UCHL1; NEDD4; CBL; UBE2I; BTRC; HSPA5; USP7; USP10; FBXW7; USP9X; STUB1; USP22; B2M; BIRC2; PARK2; USP8; USP1; VHL; HSP90AA1; BIRC3 |
| IL-10 Signaling | TRAF6; CCR1; ELK1; IKBKB; SP1; FOS; NFKB2; MAP3K14; MAPK8; MAPK13; RELA; MAPK14; TNF; IKBKG; RELB; MAP3K7; JAK1; CHUK; STAT3; NFKB1; JUN; IL1R1; IL6 |
| VDR/RXR Activation | PRKCE; EP300; PRKCZ; RXRA; GADD45A; HES1; NCOR2; SP1; PRKCI; CDKN1B; PRKD1; PRKCD; RUNX2; KLF4; YY1; NCOA3; CDKN1A; NCOA2; SPP1; LRP5; CEBPB; FOXO1; PRKCA |
| TGF-beta Signaling | EP300; SMAD2; SMURF1; MAPK1; SMAD3; SMAD1; FOS; MAPK8; MAPK3; KRAS; MAPK9; RUNX2; SERPINE1; RAF1; MAP3K7; CREBBP; MAP2K2; MAP2K1; TGFBR1; SMAD4; JUN; SMAD5 |
| Toll-like Receptor Signaling | IRAK1; EIF2AK2; MYD88; TRAF6; PPARA; ELK1; IKBKB; FOS; NFKB2; MAP3K14; MAPK8; MAPK13; RELA; TLR4; MAPK14; IKBKG; RELB; MAP3K7; CHUK; NFKB1; TLR2; JUN |
| p38 MAPK Signaling | HSPB1; IRAK1; TRAF6; MAPKAPK2; ELK1; FADD; FAS; CREB1; DDIT3; RPS6KA4; DAXX; MAPK13; TRAF2; MAPK14; TNF; MAP3K7; TGFBR1; MYC; ATF4; IL1R1; SRF; STAT1 |
| Neurotrophin/TRK Signaling | NTRK2; MAPK1; PTPN11; PIK3CA; CREB1; FOS; PIK3CB; PIK3C3; MAPK8; MAPK3; KRAS; PIK3C2A; RAF1; MAP2K2; AKT1; PIK3R1; PDPK1; MAP2K1; CDC42; JUN; ATF4 |
| FXR/RXR Activation | INS; PPARA; FASN; RXRA; AKT2; SDC1; MAPK8; APOB; MAPK10; PPARG; MTTP; MAPK9; PPARGC1A; TNF; CREBBP; AKT1; SREBF1; FGFR4; AKT3; FOXO1 |
| Synaptic Long Term Potentiation | PRKCE; RAP1A; EP300; PRKCZ; MAPK1; CREB1; PRKCI; GNAQ; CAMK2A; PRKD1; MAPK3; KRAS; PRKCD; PPP1CC; RAF1; CREBBP; MAP2K2; MAP2K1; ATF4; PRKCA |
| Calcium Signaling | RAP1A; EP300; HDAC4; MAPK1; HDAC5; CREB1; CAMK2A; MYH9; MAPK3; HDAC2; HDAC7A; HDAC11; HDAC9; HDAC3; CREBBP; CALR; CAMKK2; ATF4; HDAC6 |

TABLE C-continued

| CELLULAR FUNCTION | GENES |
|---|---|
| EGF Signaling | ELK1; MAPK1; EGFR; PIK3CA; FOS; PIK3CB; PIK3C3; MAPK8; MAPK3; PIK3C2A; RAF1; JAK1; PIK3R1; STAT3; MAP2K1; JUN; PRKCA; SRF; STAT1 |
| Hypoxia Signaling in the Cardiovascular System | EDN1; PTEN; EP300; NQO1; UBE2I; CREB1; ARNT; HIF1A; SLC2A4; NOS3; TP53; LDHA; AKT1; ATM; VEGFA; JUN; ATF4; VHL; HSP90AA1 |
| LPS/IL-1 Mediated Inhibition of RXR Function | IRAK1; MYD88; TRAF6; PPARA; RXRA; ABCA1; MAPK8; ALDH1A1; GSTP1; MAPK9; ABCB1; TRAF2; TLR4; TNF; MAP3K7; NR1H2; SREBF1; JUN; IL1R1 |
| LXR/RXR Activation | FASN; RXRA; NCOR2; ABCA1; NFKB2; IRF3; RELA; NOS2A; TLR4; TNF; RELB; LDLR; NR1H2; NFKB1; SREBF1; IL1R1; CCL2; IL6; MMP9 |
| Amyloid Processing | PRKCE; CSNK1E; MAPK1; CAPNS1; AKT2; CAPN2; CAPN1; MAPK3; MAPK13; MAPT; MAPK14; AKT1; PSEN1; CSNK1A1; GSK3B; AKT3; APP |
| IL-4 Signaling | AKT2; PIK3CA; PIK3CB; PIK3C3; IRS1; KRAS; SOCS1; PTPN6; NR3C1; PIK3C2A; JAK1; AKT1; JAK2; PIK3R1; FRAP1; AKT3; RPS6KB1 |
| Cell Cycle: G2/M DNA Damage Checkpoint Regulation | EP300; PCAF; BRCA1; GADD45A; PLK1; BTRC; CHEK1; ATR; CHEK2; YWHAZ; TP53; CDKN1A; PRKDC; ATM; SFN; CDKN2A |
| Nitric Oxide Signaling in the Cardiovascular System | KDR; FLT1; PGF; AKT2; PIK3CA; PIK3CB; PIK3C3; CAV1; PRKCD; NOS3; PIK3C2A; AKT1; PIK3R1; VEGFA; AKT3; HSP90AA1 |
| Purine Metabolism | NME2; SMARCA4; MYH9; RRM2; ADAR; EIF2AK4; PKM2; ENTPD1; RAD51; RRM2B; TJP2; RAD51C; NT5E; POLD1; NME1 |
| cAMP-mediated Signaling | RAP1A; MAPK1; GNAS; CREB1; CAMK2A; MAPK3; SRC; RAF1; MAP2K2; STAT3; MAP2K1; BRAF; ATF4 |
| Mitochondrial Dysfunction | SOD2; MAPK8; CASP8; MAPK10; MAPK9; CASP9; PARK7; PSEN1; PARK2; APP; CASP3 |
| Notch Signaling | HES1; JAG1; NUMB; NOTCH4; ADAM17; NOTCH2; PSEN1; NOTCH3; NOTCH1; DLL4 |
| Endoplasmic Reticulum Stress Pathway | HSPA5; MAPK8; XBP1; TRAF2; ATF6; CASP9; ATF4; EIF2AK3; CASP3 |
| Pyrimidine Metabolism | NME2; AICDA; RRM2; EIF2AK4; ENTPD1; RRM2B; NT5E; POLD1; NME1 |
| Parkinson's Signaling | UCHL1; MAPK8; MAPK13; MAPK14; CASP9; PARK7; PARK2; CASP3 |
| Cardiac & Beta Adrenergic Signaling | GNAS; GNAQ; PPP2R1A; GNB2L1; PPP2CA; PPP1CC; PPP2R5C |
| Glycolysis/Gluconeogenesis | HK2; GCK; GPI; ALDH1A1; PKM2; LDHA; HK1 |
| Interferon Signaling | IRF1; SOCS1; JAK1; JAK2; IFITM1; STAT1; IFIT3 |
| Sonic Hedgehog Signaling | ARRB2; SMO; GLI2; DYRK1A; GLI1; GSK3B; DYRK1B |
| Glycerophospholipid Metabolism | PLD1; GRN; GPAM; YWHAZ; SPHK1; SPHK2 |
| Phospholipid Degradation | PRDX6; PLD1; GRN; YWHAZ; SPHK1; SPHK2 |
| Tryptophan Metabolism | SIAH2; PRMT5; NEDD4; ALDH1A1; CYP1B1; SIAH1 |
| Lysine Degradation | SUV39H1; EHMT2; NSD1; SETD7; PPP2R5C |
| Nucleotide Excision Repair Pathway | ERCC5; ERCC4; XPA; XPC; ERCC1 |
| Starch and Sucrose Metabolism | UCHL1; HK2; GCK; GPI; HK1 |
| Aminosugars Metabolism | NQO1; HK2; GCK; HK1 |
| Arachidonic Acid Metabolism | PRDX6; GRN; YWHAZ; CYP1B1 |
| Circadian Rhythm Signaling | CSNK1E; CREB1; ATF4; NR1D1 |
| Coagulation System | BDKRB1; F2R; SERPINE1; F3 |
| Dopamine Receptor Signaling | PPP2R1A; PPP2CA; PPP1CC; PPP2R5C |
| Glutathione Metabolism | IDH2; GSTP1; ANPEP; IDH1 |
| Glycerolipid Metabolism | ALDH1A1; GPAM; SPHK1; SPHK2 |
| Linoleic Acid Metabolism | PRDX6; GRN; YWHAZ; CYP1B1 |
| Methionine Metabolism | DNMT1; DNMT3B; AHCY; DNMT3A |
| Pyruvate Metabolism | GLO1; ALDH1A1; PKM2; LDHA |
| Arginine and Proline Metabolism | ALDH1A1; NOS3; NOS2A |
| Eicosanoid Signaling | PRDX6; GRN; YWHAZ |
| Fructose and Mannose Metabolism | HK2; GCK; HK1 |
| Galactose Metabolism | HK2; GCK; HK1 |
| Stilbene, Coumarine and Lignin Biosynthesis | PRDX6; PRDX1; TYR |

TABLE C-continued

| CELLULAR FUNCTION | GENES |
|---|---|
| Antigen Presentation Pathway | CALR; B2M |
| Biosynthesis of Steroids | NQO1; DHCR7 |
| Butanoate Metabolism | ALDH1A1; NLGN1 |
| Citrate Cycle | IDH2; IDH1 |
| Fatty Acid Metabolism | ALDH1A1; CYP1B1 |
| Glycerophospholipid Metabolism | PRDX6; CHKA |
| Histidine Metabolism | PRMT5; ALDH1A1 |
| Inositol Metabolism | ERO1L; APEX1 |
| Metabolism of Xenobiotics by Cytochrome p450 | GSTP1; CYP1B1 |
| Methane Metabolism | PRDX6; PRDX1 |
| Phenylalanine Metabolism | PRDX6; PRDX1 |
| Propanoate Metabolism | ALDH1A1; LDHA |
| Selenoamino Acid Metabolism | PRMT5; AHCY |
| Sphingolipid Metabolism | SPHK1; SPHK2 |
| Aminophosphonate Metabolism | PRMT5 |
| Androgen and Estrogen Metabolism | PRMT5 |
| Ascorbate and Aldarate Metabolism | ALDH1A1 |
| Bile Acid Biosynthesis | ALDH1A1 |
| Cysteine Metabolism | LDHA |
| Fatty Acid Biosynthesis | FASN |
| Glutamate Receptor Signaling | GNB2L1 |
| NRF2-mediated Oxidative Stress Response | PRDX1 |
| Pentose Phosphate Pathway | GPI |
| Pentose and Glucuronate Interconversions | UCHL1 |
| Retinol Metabolism | ALDH1A1 |
| Riboflavin Metabolism | TYR |
| Tyrosine Metabolism | PRMT5, TYR |
| Ubiquinone Biosynthesis | PRMT5 |
| Valine, Leucine and Isoleucine Degradation | ALDH1A1 |
| Glycine, Serine and Threonine Metabolism | CHKA |
| Lysine Degradation | ALDH1A1 |
| Pain/Taste | TRPM5; TRPA1 |
| Pain | TRPM7; TRPC5; TRPC6; TRPC1; Cnr1; cnr2; Grk2; Trpa1; Pomc; Cgrp; Crf; Pka; Era; Nr2b; TRPM5; Prkaca; Prkacb; Prkar1a; Prkar2a |
| Mitochondrial Function | AIF; CytC; SMAC (Diablo); Aifm-1; Aifm-2 |
| Developmental Neurology | BMP-4; Chordin (Chrd); Noggin (Nog); WNT (Wnt2; Wnt2b; Wnt3a; Wnt4; Wnt5a; Wnt6; Wnt7b; Wnt8b; Wnt9a; Wnt9b; Wnt10a; Wnt10b; Wnt16); beta-catenin; Dkk-1; Frizzled related proteins; Otx-2; Gbx2; FGF-8; Reelin; Dab1; unc-86 (Pou4f1 or Brn3a); Numb; Reln |

Embodiments of the invention also relate to methods and compositions related to knocking out genes, amplifying genes and repairing particular mutations associated with DNA repeat instability and neurological disorders (Robert D. Wells, Tetsuo Ashizawa, Genetic Instabilities and Neurological Diseases, Second Edition, Academic Press, Oct. 13, 2011—Medical). Specific aspects of tandem repeat sequences have been found to be responsible for more than twenty human diseases (New insights into repeat instability: role of RNA•DNA hybrids. McIvor E I, Polak U, Napierala M. RNA Biol. 2010 September-October; 7(5):551-8). The CRISPR-Cas system may be harnessed to correct these defects of genomic instability.

A further aspect of the invention relates to utilizing the CRISPR-Cas system for correcting defects in the EMP2A and EMP2B genes that have been identified to be associated with Lafora disease. Lafora disease is an autosomal recessive condition which is characterized by progressive myoclonus epilepsy which may start as epileptic seizures in adolescence. A few cases of the disease may be caused by mutations in genes yet to be identified. The disease causes seizures, muscle spasms, difficulty walking, dementia, and eventually death. There is currently no therapy that has proven effective against disease progression. Other genetic abnormalities associated with epilepsy may also be targeted by the CRISPR-Cas system and the underlying genetics is further described in Genetics of Epilepsy and Genetic Epilepsies, edited by Giuliano Avanzini, Jeffrey L. Noebels, Mariani Foundation Paediatric Neurology:20; 2009).

In yet another aspect of the invention, the CRISPR-Cas system may be used to correct ocular defects that arise from several genetic mutations further described in Genetic Diseases of the Eye, Second Edition, edited by Elias I. Traboulsi, Oxford University Press, 2012.

Several further aspects of the invention relate to correcting defects associated with a wide range of genetic diseases which are further described on the website of the National Institutes of Health under the topic subsection Genetic Disorders (website at health.nih.gov/topic/GeneticDisorders). The genetic brain diseases may include but are not limited to Adrenoleukodystrophy, Agenesis of the Corpus Callosum, Aicardi Syndrome, Alpers' Disease, Alzheimer's Disease, Barth Syndrome, Batten Disease, CADASIL, Cerebellar Degeneration, Fabry's Disease, Gerstmann-Straussler-Scheinker Disease, Huntington's Disease and other Triplet Repeat Disorders, Leigh's Disease, Lesch-Nyhan Syndrome, Menkes Disease, Mitochondrial Myopathies and NINDS Colpocephaly. These diseases are further described on the website of the National Institutes of Health under the subsection Genetic Brain Disorders.

In some embodiments, the condition may be neoplasia. In some embodiments, where the condition is neoplasia, the genes to be targeted are any of those listed in Table A (in this case PTEN asn so forth). In some embodiments, the condition may be Age-related Macular Degeneration. In some embodiments, the condition may be a Schizophrenic Disorder. In some embodiments, the condition may be a Trinucleotide Repeat Disorder. In some embodiments, the condition may be Fragile X Syndrome. In some embodiments, the condition may be a Secretase Related Disorder. In some embodiments, the condition may be a Prion-related disorder. In some embodiments, the condition may be ALS. In some embodiments, the condition may be a drug addiction. In some embodiments, the condition may be Autism. In some embodiments, the condition may be Alzheimer's Disease. In some embodiments, the condition may be inflammation. In some embodiments, the condition may be Parkinson's Disease.

Examples of proteins associated with Parkinson's disease include but are not limited to α-synuclein, DJ-1, LRRK2, PINK1, Parkin, UCHL1, Synphilin-1, and NURR1.

Examples of addiction-related proteins may include ABAT for example.

Examples of inflammation-related proteins may include the monocyte chemoattractant protein-1 (MCP1) encoded by the Ccr2 gene, the C-C chemokine receptor type 5 (CCR5) encoded by the Ccr5 gene, the IgG receptor IIB (FCGR2b, also termed CD32) encoded by the Fcgr2b gene, or the Fc epsilon R1g (FCER1g) protein encoded by the Fcer1g gene, for example.

Examples of cardiovascular diseases associated proteins may include IL1B (interleukin 1, beta), XDH (xanthine dehydrogenase), TP53 (tumor protein p53), PTGIS (prostaglandin 12 (prostacyclin) synthase), MB (myoglobin), IL4 (interleukin 4), ANGPT1 (angiopoietin 1), ABCG8 (ATP-binding cassette, sub-family G (WHITE), member 8), or CTSK (cathepsin K), for example.

Examples of Alzheimer's disease associated proteins may include the very low density lipoprotein receptor protein (VLDLR) encoded by the VLDLR gene, the ubiquitin-like modifier activating enzyme 1 (UBA1) encoded by the UBA1 gene, or the NEDD8-activating enzyme E1 catalytic subunit protein (UBE1C) encoded by the UBA3 gene, for example.

Examples of proteins associated Autism Spectrum Disorder may include the benzodiazapine receptor (peripheral) associated protein 1 (BZRAP1) encoded by the BZRAP1 gene, the AF4/FMR2 family member 2 protein (AFF2) encoded by the AFF2 gene (also termed MFR2), the fragile X mental retardation autosomal homolog 1 protein (FXR1) encoded by the FXR1 gene, or the fragile X mental retardation autosomal homolog 2 protein (FXR2) encoded by the FXR2 gene, for example.

Examples of proteins associated Macular Degeneration may include the ATP-binding cassette, sub-family A (ABC1) member 4 protein (ABCA4) encoded by the ABCR gene, the apolipoprotein E protein (APOE) encoded by the APOE gene, or the chemokine (C-C motif) Ligand 2 protein (CCL2) encoded by the CCL2 gene, for example.

Examples of proteins associated Schizophrenia may include NRG1, ErbB4, CPLX1, TPH1, TPH2, NRXN1, GSK3A, BDNF, DISC1, GSK3B, and combinations thereof.

Examples of proteins involved in tumor suppression may include ATM (ataxia telangiectasia mutated), ATR (ataxia telangiectasia and Rad3 related), EGFR (epidermal growth factor receptor), ERBB2 (v-erb-b2 erythroblastic leukemia viral oncogene homolog 2), ERBB3 (v-erb-b2 erythroblastic leukemia viral oncogene homolog 3), ERBB4 (v-erb-b2 erythroblastic leukemia viral oncogene homolog 4), Notch 1, Notch2, Notch 3, or Notch 4, for example.

Examples of proteins associated with a secretase disorder may include PSENEN (presenilin enhancer 2 homolog (C. elegans)), CTSB (cathepsin B), PSEN1 (presenilin 1), APP (amyloid beta (A4) precursor protein), APH1B (anterior pharynx defective 1 homolog B (C. elegans)), PSEN2 (presenilin 2 (Alzheimer disease 4)), or BACE1 (beta-site APP-cleaving enzyme 1), for example.

Examples of proteins associated with Amyotrophic Lateral Sclerosis may include SOD1 (superoxide dismutase 1), ALS2 (amyotrophic lateral sclerosis 2), FUS (fused in sarcoma), TARDBP (TAR DNA binding protein), VAGFA (vascular endothelial growth factor A), VAGFB (vascular endothelial growth factor B), and VAGFC (vascular endothelial growth factor C), and any combination thereof.

Examples of proteins associated with prion diseases may include SOD1 (superoxide dismutase 1), ALS2 (amyotrophic lateral sclerosis 2), FUS (fused in sarcoma), TARDBP (TAR DNA binding protein), VAGFA (vascular endothelial growth factor A), VAGFB (vascular endothelial growth factor B), and VAGFC (vascular endothelial growth factor C), and any combination thereof.

Examples of proteins related to neurodegenerative conditions in prion disorders may include A2M (Alpha-2-Macroglobulin), AATF (Apoptosis antagonizing transcription factor), ACPP (Acid phosphatase prostate), ACTA2 (Actin alpha 2 smooth muscle aorta), ADAM22 (ADAM metallopeptidase domain), ADORA3 (Adenosine A3 receptor), or ADRA1D (Alpha-1D adrenergic receptor for Alpha-1D adrenoreceptor), for example.

Examples of proteins associated with Immunodeficiency may include A2M [alpha-2-macroglobulin]; AANAT [arylalkylamine N-acetyltransferase]; ABCA1 [ATP-binding cassette, sub-family A (ABC1), member 1]; ABCA2 [ATP-binding cassette, sub-family A (ABC1), member 2]; or ABCA3 [ATP-binding cassette, sub-family A (ABC1), member 3]; for example.

Examples of proteins associated with Trinucleotide Repeat Disorders include AR (androgen receptor), FMR1 (fragile X mental retardation 1), HTT (huntingtin), or DMPK (dystrophia myotonica-protein kinase), FXN (frataxin), ATXN2 (ataxin 2), for example.

Examples of proteins associated with Neurotransmission Disorders include SST (somatostatin), NOS1 (nitric oxide synthase 1 (neuronal)), ADRA2A (adrenergic, alpha-2A-, receptor), ADRA2C (adrenergic, alpha-2C-, receptor), TACR1 (tachykinin receptor 1), or HTR2c (5-hydroxytryptamine (serotonin) receptor 2C), for example.

Examples of neurodevelopmental-associated sequences include A2BP1 [ataxin 2-binding protein 1], AADAT [aminoadipate aminotransferase], AANAT [arylalkylamine N-acetyltransferase], ABAT [4-aminobutyrate aminotransferase], ABCA1 [ATP-binding cassette, sub-family A (ABC1), member 1], or ABCA13 [ATP-binding cassette, sub-family A (ABC1), member 13], for example.

Further examples of preferred conditions treatable with the present system include may be selected from: Aicardi-Goutières Syndrome; Alexander Disease; Allan-Herndon-Dudley Syndrome; POLG-Related Disorders; Alpha-Mannosidosis (Type II and III); Alström Syndrome; Angelman; Syndrome; Ataxia-Telangiectasia; Neuronal Ceroid-Lipofuscinoses; Beta-Thalassemia; Bilateral Optic Atrophy and (Infantile) Optic Atrophy Type 1; Retinoblastoma (bilateral); Canavan Disease; Cerebrooculofacioskeletal Syndrome 1 [COF 51]; Cerebrotendinous Xanthomatosis; Cornelia de Lange Syndrome; MAPT-Related Disorders; Genetic Prion Diseases; Dravet Syndrome; Early-Onset Familial Alzheimer Disease; Friedreich Ataxia [FRDA]; Fryns Syndrome; Fucosidosis; Fukuyama Congenital Muscular Dystrophy; Galactosialidosis; Gaucher Disease; Organic Acidemias; Hemophagocytic Lymphohistiocytosis; Hutchinson-Gilford Progeria Syndrome; Mucolipidosis II; Infantile Free Sialic Acid Storage Disease; PLA2G6-Associated Neurodegeneration; Jervell and Lange-Nielsen Syndrome; Junctional Epidermolysis Bullosa; Huntington Disease; Krabbe Disease (Infantile); Mitochondrial DNA-Associated Leigh Syndrome and NARP; Lesch-Nyhan Syndrome; LIS1-Associated Lissencephaly; Lowe Syndrome; Maple Syrup Urine Disease; MECP2 Duplication Syndrome; ATP7A-Related Copper Transport Disorders; LAMA2-Related Muscular Dystrophy; Arylsulfatase A Deficiency; Mucopolysaccharidosis Types I, II or III; Peroxisome Biogenesis Disorders, Zellweger Syndrome Spectrum; Neurodegeneration with Brain Iron Accumulation Disorders; Acid Sphingomyelinase Deficiency; Niemann-Pick Disease Type C; Glycine Encephalopathy; ARX-Related Disorders; Urea Cycle Disorders; COL1A1/2-Related Osteogenesis Imperfecta; Mitochondrial DNA Deletion Syndromes; PLP1-Related Disorders; Perry Syndrome; Phelan-McDermid Syndrome; Glycogen Storage Disease Type II (Pompe Disease) (Infantile); MAPT-Related Disorders; MECP2-Related Disorders; Rhizomelic Chondrodysplasia Punctata Type 1; Roberts Syndrome; Sandhoff Disease; Schindler Disease-Type 1; Adenosine Deaminase Deficiency; Smith-Lemli-Opitz Syndrome; Spinal Muscular Atrophy; Infantile-Onset Spinocerebellar Ataxia; Hexosaminidase A Deficiency; Thanatophoric Dysplasia Type 1; Collagen Type VI-Related Disorders; Usher Syndrome Type I; Congenital Muscular Dystrophy; Wolf-Hirschhorn Syndrome; Lysosomal Acid Lipase Deficiency; and Xeroderma Pigmentosum.

As will be apparent, it is envisaged that the present system can be used to target any polynucleotide sequence of interest. Some examples of conditions or diseases that might be usefully treated using the present system are included in the Tables above and examples of genes currently associated with those conditions are also provided there. However, the genes exemplified are not exhaustive.

Aspects of the invention also encompass delivery of engineered and optimized CRISPR-Cas systems. Cas9 and one or more guide RNA can be delivered using adeno associated virus (AAV), lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses may be based on or extrapolated to an average 70 kg individual, and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed.

The viral vectors can be injected into the tissue of interest. For cell-type specific genome modification, the expression of Cas9 can be driven by a cell-type specific promoter. For example, liver-specific expression might use the Albumin promoter and neuron-specific expression might use the Synapsin I promoter.

Transgenic Animals and Plants

Figures 25A, 25B:
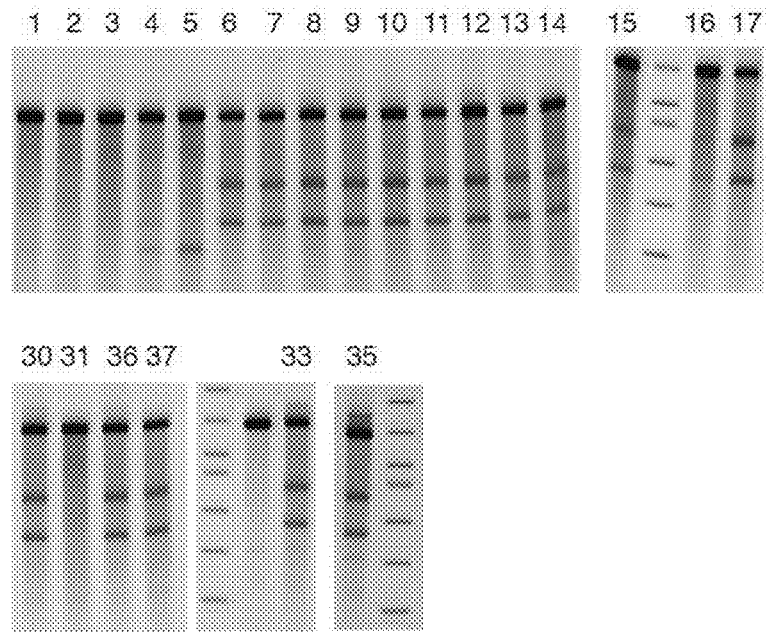
FIGS. 25A-B show Surveyor gel test results of SpCas9 truncation mutants from the crystal structure that retain cleavage activity (A) and a table showing the amino acid truncations and flexible (GGGS) (SEQ ID NO: 1) or rigid (A(EAAAK)) (SEQ ID NO: 7) linker substitutions of the lanes of the gels of FIG. 25A (B).

Transgenic animals are also provided. Preferred examples include animals comprising Cas9, in terms of polynucleotides encoding Cas9 or the protein itself. Mice, rats and rabbits are preferred. To generate transgenic mice with the constructs, as exemplified herein one may inject pure, linear DNA into the pronucleus of a zygote from a pseudo pregnant female, e.g. a CB56 female. Founders may then be identified, genotyped, and backcrossed to CB57 mice. The constructs may then be cloned and optionally verified, for instance by Sanger sequencing. Knock outs are envisaged where for instance one or more genes are knocked out in a model. However, are knockins are also envisaged (alone or in combination). An example knockin Cas9 mouse was generated and this is exemplified, but Cas9 knockins are preferred. To generate a Cas9 knock in mice one may target the same constitutive and conditional constructs to the Rosa26 locus, as described herein (FIGS. 25A-B and 26). Methods of US Patent Publication Nos. 20120017290 and 20110265198 assigned to Sangamo BioSciences, Inc. directed to targeting the Rosa locus may be modified to utilize the CRISPR Cas system of the present invention. In another embodiment, the methods of US Patent Publication No. 20130236946 assigned to Cellectis directed to targeting the Rosa locus may also be modified to utilize the CRISPR Cas system of the present invention.

Utility of the conditional Cas9 mouse: Applicants have shown in 293 cells that the Cas9 conditional expression construct can be activated by co-expression with Cre. Applicants also show that the correctly targeted R1 mESCs can have active Cas9 when Cre is expressed. Because Cas9 is followed by the P2A peptide cleavage sequence and then EGFP Applicants identify successful expression by observing EGFP. Applicants have shown Cas9 activation in mESCs. This same concept is what makes the conditional Cas9 mouse so useful. Applicants may cross their conditional Cas9 mouse with a mouse that ubiquitously expresses Cre (ACTB-Cre line) and may arrive at a mouse that expresses Cas9 in every cell. It should only take the delivery of chimeric RNA to induce genome editing in embryonic or adult mice. Interestingly, if the conditional Cas9 mouse is crossed with a mouse expressing Cre under a tissue specific promoter, there should only be Cas9 in the tissues that also express Cre. This approach may be used to edit the genome in only precise tissues by delivering chimeric RNA to the same tissue.

As mentioned above, transgenic animals are also provided, as are transgenic plants, especially crops and algae. The transgenic plants may be useful in applications outside of providing a disease model. These may include food or feed production through expression of, for instance, higher protein, carbohydrate, nutrient or vitamin levels than would normally be seen in the wildtype. In this regard, transgenic plants, especially pulses and tubers, and animals, especially mammals such as livestock (cows, sheep, goats and pigs), but also poultry and edible insects, are preferred.

Transgenic algae or other plants such as rape may be particularly useful in the production of vegetable oils or biofuels such as alcohols (especially methanol and ethanol), for instance. These may be engineered to express or over-express high levels of oil or alcohols for use in the oil or biofuel industries.

Adeno Associated Virus (AAV)

In terms of in vivo delivery, AAV is advantageous over other viral vectors for a couple of reasons:

Low toxicity (this may be due to the purification method not requiring ultra centrifugation of cell particles that can activate the immune response)

Low probability of causing insertional mutagenesis because it doesn't integrate into the host genome.

AAV has a packaging limit of 4.5 or 4.75 Kb. This means that Cas9 as well as a promoter and transcription terminator have to be all fit into the same viral vector. Constructs larger than 4.5 or 4.75 Kb will lead to significantly reduced virus production. SpCas9 is quite large, the gene itself is over 4.1 Kb, which makes it difficult for packing into AAV. Therefore embodiments of the invention include utilizing homologs of Cas9 that are shorter. For example:

| Species | Cas9 Size |
|---|---|
| *Corynebacter diphtheriae* | 3252 |
| *Eubacterium ventriosum* | 3321 |
| *Streptococcus pasteurianus* | 3390 |
| *Lactobacillus farciminis* | 3378 |
| *Sphaerochaeta globus* | 3537 |
| *Azospirillum* B510 | 3504 |
| *Gluconacetobacter diazotrophicus* | 3150 |
| *Neisseria cinerea* | 3246 |
| *Roseburia intestinalis* | 3420 |
| *Parvibaculum lavamentivorans* | 3111 |
| *Staphylococcus aureus* | 3159 |
| *Nitratifractor salsuginis* DSM 16511 | 3396 |
| *Campylobacter lari* CF89-12 | 3009 |
| *Streptococcus thermophilus* LMD-9 | 3396 |

These species are therefore, in general, preferred Cas9 species. Applicants have shown delivery and in vivo mouse brain Cas9 expression data.

Two ways to package Cas9 coding nucleic acid molecules, e.g., DNA, into viral vectors to mediate genome modification in vivo are preferred:

To Achieve NHEJ-Mediated Gene Knockout:
Single Virus Vector:
Vector containing two or more expression cassettes:
Promoter-Cas9 coding nucleic acid molecule-terminator
Promoter-gRNA1-terminator
Promoter-gRNA2-terminator
Promoter-gRNA(N)-terminator (up to size limit of vector)

Double Virus Vector:
Vector 1 containing one expression cassette for driving the expression of Cas9
Promoter-Cas9 coding nucleic acid molecule-terminator
Vector 2 containing one more expression cassettes for driving the expression of one or more guideRNAs
Promoter-gRNA1-terminator
Promoter-gRNA(N)-terminator (up to size limit of vector)

To mediate homology-directed repair: In addition to the single and double virus vector approaches described above, an additional vector is used to deliver a homology-direct repair template.

Promoter used to drive Cas9 coding nucleic acid molecule expression can include: AAV ITR can serve as a promoter: this is advantageous for eliminating the need for an additional promoter element (which can take up space in the vector). The additional space freed up can be used to drive the expression of additional elements (gRNA, etc.). Also, ITR activity is relatively weaker, so can be used to reduce toxicity due to over expression of Cas9.

For ubiquitous expression, can use promoters: CMV, CAG, CBh, PGK, SV40, Ferritin heavy or light chains, etc.

For brain expression, can use promoters: SynapsinI for all neurons, CaMKIIalpha for excitatory neurons, GAD67 or GAD65 or VGAT for GABAergic neurons, etc.

For liver expression, can use Albumin promoter.
For lung expression, can use SP-B.
For endothelial cells, can use ICAM.
For hematopoietic cells can use IFNbeta or CD45.
For Osteoblasts can use OG-2.
Promoter used to drive guide RNA can include:
Pol III promoters such as U6 or H1
Use of Pol II promoter and intronic cassettes to express gRNA.

As to AAV, the AAV can be AAV1, AAV2, AAV5 or any combination thereof. One can select the AAV of the AAV with regard to the cells to be targeted; e.g., one can select AAV serotypes 1, 2, 5 or a hybrid or capsid AAV1, AAV2, AAV5 or any combination thereof for targeting brain or neuronal cells; and one can select AAV4 for targeting cardiac tissue. AAV8 is useful for delivery to the liver. The above promoters and vectors are preferred individually.

RNA delivery is also a useful method of in vivo delivery. It is possible to deliver Cas9 and gRNA (and, for instance, HR repair template) into cells using liposomes or nanoparticles. Thus delivery of the CRISPR enzyme, such as a Cas9 and/or delivery of the RNAs of the invention may be in RNA form and via microvesicles, liposomes or nanoparticles. For example, Cas9 mRNA and gRNA can be packaged into liposomal particles for delivery in vivo. Liposomal transfection reagents such as lipofectamine from Life Technologies and other reagents on the market can effectively deliver RNA molecules into the liver.

Enhancing NHEJ or HR efficiency is also helpful for delivery. It is preferred that NHEJ efficiency is enhanced by co-expressing end-processing enzymes such as Trex2 (Dumitrache et al. Genetics. 2011 August; 188(4): 787-797). It is preferred that HR efficiency is increased by transiently inhibiting NHEJ machineries such as Ku70 and Ku86. HR efficiency can also be increased by co-expressing prokaryotic or eukaryotic homologous recombination enzymes such as RecBCD, RecA.

Various means of delivery are described herein, and further discussed in this section.

Viral delivery: The CRISPR enzyme, for instance a Cas9, and/or any of the present RNAs, for instance a guide RNA, can be delivered using adeno associated virus (AAV), lentivirus, adenovirus or other viral vector types, or combinations thereof. Cas9 and one or more guide RNAs can be packaged into one or more viral vectors. In some embodiments, the viral vector is delivered to the tissue of interest by, for example, an intramuscular injection, while other times the viral delivery is via intravenous, transdermal, intranasal, oral, mucosal, or other delivery methods. Such delivery may be either via a single dose, or multiple doses. One skilled in the art understands that the actual dosage to be delivered herein may vary greatly depending upon a variety of factors, such as the vector chose, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, an adjuvant to enhance antigenicity, an immunostimulatory compound or molecule, and/or other compounds known in the art. The adjuvant herein may contain a suspension of minerals (alum, aluminum hydroxide, aluminum phosphate) on which antigen is adsorbed; or water-in-oil emulsion in which antigen solution is emulsified in oil (MF-59, Freund's incomplete adjuvant), sometimes with the inclusion of killed mycobacteria (Freund's complete adjuvant) to further enhance antigenicity (inhibits degradation of antigen and/or causes influx of macrophages). Adjuvants also include immunostimulatory molecules, such as cytokines, costimulatory molecules, and for example, immunostimulatory DNA or RNA molecules, such as CpG oligonucleotides. Such a dosage formulation is readily ascertainable by one skilled in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in REMINGTON'S PHARMACEUTICAL SCIENCES (Mack Pub. Co., N.J. 1991) which is incorporated by reference herein.

In an embodiment herein the delivery is via an adenovirus, which may be at a single booster dose containing at least $1\times10^5$ particles (also referred to as particle units, pu) of adenoviral vector. In an embodiment herein, the dose preferably is at least about $1\times10^6$ particles (for example, about $1\times10^6$-$1\times10^{12}$ particles), more preferably at least about $1\times10^7$ particles, more preferably at least about $1\times10^8$ particles (e.g., about $1\times10^8$-$1\times10^{11}$ particles or about $1\times10^8$-$1\times10^{12}$ particles), and most preferably at least about $1\times10^9$ particles (e.g., about $1*\times10^9$-$1\times10^{10}$ particles or about $1\times10^9$-$1\times10^{12}$ particles), or even at least about $1\times10^{10}$ particles (e.g., about $1\times10^{10}$-$1\times10^{12}$ particles) of the adenoviral vector. Alternatively, the dose comprises no more than about $1\times10^{14}$ particles, preferably no more than about $1\times10^{13}$ particles, even more preferably no more than about $1\times10^{12}$ particles, even more preferably no more than about $1\times10^{11}$ particles, and most preferably no more than about $1\times10^{10}$ particles (e.g., no more than about $1\times10^9$ articles). Thus, the dose may contain a single dose of adenoviral vector with, for example, about $1\times10^6$ particle units (pu), about $2\times10^6$ pu, about $4\times10^6$ pu, about $1\times10^7$ pu, about $2\times10^7$ pu, about $4\times10^7$ pu, about $1\times10^8$ pu, about $2\times10^8$ pu, about $4\times10^8$ pu, about $1\times10^9$ pu, about $2\times10^9$ pu, about $4\times10^9$ pu, about $1\times10^{10}$ pu, about $2\times10^{10}$ pu, about $4\times10^{10}$ pu, about $1\times10^{11}$ pu, about $2\times10^{11}$ pu, about $4\times10^{11}$ pu, about $1\times10^{12}$ pu, about $2\times10^{12}$ pu, or about $4\times10^{12}$ pu of adenoviral vector. See, for example, the adenoviral vectors in U.S. Pat. No. 8,454,972 B2 to Nabel, et. al., granted on Jun. 4, 2013; incorporated by reference herein, and the dosages at col 29, lines 36-58 thereof. In an embodiment herein, the adenovirus is delivered via multiple doses.

In an embodiment herein, the delivery is via an AAV. A therapeutically effective dosage for in vivo delivery of the AAV to a human is believed to be in the range of from about 20 to about 50 ml of saline solution containing from about $1\times10^{10}$ to about $1\times10^{10}$ functional AAV/ml solution. The dosage may be adjusted to balance the therapeutic benefit against any side effects. In an embodiment herein, the AAV dose is generally in the range of concentrations of from about $1\times10^5$ to $1\times10^{50}$ genomes AAV, from about $1\times10^8$ to $1\times10^{20}$ genomes AAV, from about $1\times10^{10}$ to about $1\times10^{16}$ genomes, or about $1\times10^{11}$ to about $1\times10^{16}$ genomes AAV. A human dosage may be about $1\times10^{13}$ genomes AAV. Such concentrations may be delivered in from about 0.001 ml to about 100 ml, about 0.05 to about 50 ml, or about 10 to about 25 ml of a carrier solution. Other effective dosages can be readily established by one of ordinary skill in the art through routine trials establishing dose response curves. See, for example, U.S. Pat. No. 8,404,658 B2 to Hajjar, et al., granted on Mar. 26, 2013, at col. 27, lines 45-60.

In an embodiment herein the delivery is via a plasmid. In such plasmid compositions, the dosage should be a sufficient amount of plasmid to elicit a response. For instance, suitable quantities of plasmid DNA in plasmid compositions can be from about 0.1 to about 2 mg, or from about 1 µg to about 10 µg.

The doses herein are based on an average 70 kg individual. The frequency of administration is within the ambit of the medical or veterinary practitioner (e.g., physician, veterinarian), or scientist skilled in the art.

Lentivirus

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses may be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media was changed to OptiMEM (serum-free) media and transfection was done 4 hours later. Cells were transfected with 10 µg of lentiviral transfer plasmid (pCasES10) and the following packaging plasmids: 5 µg of pMD2.G (VSV-g pseudotype), and 7.5 ug of psPAX2 (gag/pol/rev/tat). Transfection was done in 4 mL OptiMEM with a cationic lipid delivery agent (50 uL Lipofectamine 2000 and 100 ul Plus reagent). After 6 hours, the media was changed to antibiotic-free DMEM with 10% fetal bovine serum.

Lentivirus may be purified as follows. Viral supernatants were harvested after 48 hours. Supernatants were first cleared of debris and filtered through a 0.45 um low protein binding (PVDF) filter. They were then spun in a ultracentrifuge for 2 hours at 24,000 rpm. Viral pellets were resuspended in 50 ul of DMEM overnight at 4 C. They were then aliquotted and immediately frozen at −80 C.

In another embodiment, minimal non-primate lentiviral vectors based on the equine infectious anemia virus (EIAV) are also contemplated, especially for ocular gene therapy (see, e.g., Balagaan, J Gene Med 2006; 8: 275-285, Published online 21 Nov. 2005 in Wiley InterScience (www.interscience.wiley.com). DOI: 10.1002/jgm.845). In another embodiment, RetinoStat®, an equine infectious anemia virus-based lentiviral gene therapy vector that expresses angiostatic proteins endostain and angiostatin that is delivered via a subretinal injection for the treatment of the web form of age-related macular degeneration is also contemplated (see, e.g., Binley et al., HUMAN GENE THERAPY 23:980-991 (September 2012)) may be modified for the CRISPR-Cas system of the present invention.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used/and or adapted to the CRISPR-Cas system of the present invention. A minimum of $2.5 \times 10^6$ CD34+ cells per kilogram patient weight may be collected and prestimulated for 16 to 20 hours in X-VIVO 15 medium (Lonza) containing 2 mML-glutamine, stem cell factor (100 ng/ml), Flt-3 ligand (Flt-3L) (100 ng/ml), and thrombopoietin (10 ng/ml) (CellGenix) at a density of $2 \times 10^6$ cells/ml. Prestimulated cells may be transduced with lentiviral at a multiplicity of infection of 5 for 16 to 24 hours in 75-cm² tissue culture flasks coated with fibronectin (25 mg/cm²) (RetroNectin, Takara Bio Inc.).

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189; US20090017543; US20070054961, US20100317109. Lentiviral vectors have also been disclosed for delivery to the train, see, e.g., US Patent Publication Nos. US20110293571; US20110293571, US20040013648, US20070025970, US20090111106 and U.S. Pat. No. 7,259,015.

RNA Delivery

RNA delivery: The CRISPR enzyme, for instance a Cas9, and/or any of the present RNAs, for instance a guide RNA, can also be delivered in the form of RNA. Cas9 mRNA can be generated using in vitro transcription. For example, Cas9 mRNA can be synthesized using a PCR cassette containing the following elements: T7_promoter-kozak sequence (GCCACC)-Cas9-3' UTR from beta globin-polyA tail (a string of 120 or more adenines). The cassette can be used for transcription by T7 polymerase. Guide RNAs can also be transcribed using in vitro transcription from a cassette containing T7_promoter-GG-guide RNA sequence.

To enhance expression and reduce toxicity, the CRISPR enzyme and/or guide RNA can be modified using pseudo-U or 5-Methyl-C.

mRNA delivery methods are especially promising for liver delivery currently. In particular, for AAV8 is particularly preferred for delivery to the liver.

Nanoparticles

CRISPR enzyme mRNA and guide RNA may be delivered simultaneously using nanoparticles or lipid envelopes.

For example, Su X, Fricke J, Kavanagh D G, Irvine D J ("In vitro and in vivo mRNA delivery using lipid-enveloped pH-responsive polymer nanoparticles" Mol Pharm. 2011 Jun. 6; 8(3):774-87. doi: 10.1021/mp100390w. Epub 2011 Apr. 1) describes biodegradable core-shell structured nanoparticles with a poly(β-amino ester) (PBAE) core enveloped by a phospholipid bilayer shell. These were developed for in vivo mRNA delivery. The pH-responsive PBAE component was chosen to promote endosome disruption, while the lipid surface layer was selected to minimize toxicity of the polycation core. Such are, therefore, preferred for delivering RNA of the present invention.

In one embodiment, nanoparticles based on self assembling bioadhesive polymers are contemplated, which may be applied to oral delivery of peptides, intravenous delivery of peptides and nasal delivery of peptides, all to the brain. Other embodiments, such as oral absorption and ocular deliver of hydrophobic drugs are also contemplated. The molecular envelope technology involves an engineered polymer envelope which is protected and delivered to the site of the disease (see, e.g., Mazza, M. et al. ACSNano, 2013. 7(2): 1016-1026; Siew, A., et al. Mol Pharm, 2012. 9(1):14-28; Lalatsa, A., et al. J Contr Rel, 2012. 161(2):523-36; Lalatsa, A., et al., Mol Pharm, 2012. 9(6):1665-80; Lalatsa, A., et al. Mol Pharm, 2012. 9(6):1764-74; Garrett, N. L., et al. J Biophotonics, 2012. 5(5-6):458-68; Garrett, N. L., et al. J Raman Spect, 2012. 43(5):681-688; Ahmad, S., et al. J Royal Soc Interface 2010. 7:S423-33; Uchegbu, I. F. Expert Opin Drug Deliv, 2006. 3(5):629-40; Qu, X., et al. Biomacromolecules, 2006. 7(12):3452-9 and Uchegbu, I. F., et al. Int J Pharm, 2001. 224:185-199). Doses of about 5 mg/kg are contemplated, with single or multiple doses, depending on the target tissue.

In one embodiment, nanoparticles that can deliver RNA to a cancer cell to stop tumor growth developed by Dan Anderson's lab at MIT may be used/and or adapted to the CRISPR Cas system of the present invention. In particular, the Anderson lab developed fully automated, combinatorial systems for the synthesis, purification, characterization, and formulation of new biomaterials and nanoformulations. See, e.g., Alabi et al., Proc Natl Acad Sci USA. 2013 Aug. 6; 110(32):12881-6; Zhang et al., Adv Mater. 2013 Sep. 6; 25(33):4641-5; Jiang et al., Nano Lett. 2013 Mar. 13; 13(3):1059-64; Karagiannis et al., ACS Nano. 2012 Oct. 23; 6(10):8484-7; Whitehead et al., ACS Nano. 2012 Aug. 28; 6(8):6922-9 and Lee et al., Nat Nanotechnol. 2012 Jun. 3; 7(6):389-93.

US patent application 20110293703 relates to lipidoid compounds are also particularly useful in the administration of polynucleotides, which may be applied to deliver the CRISPR Cas system of the present invention. In one aspect, the aminoalcohol lipidoid compounds are combined with an agent to be delivered to a cell or a subject to form microparticles, nanoparticles, liposomes, or micelles. The agent to be delivered by the particles, liposomes, or micelles may be in the form of a gas, liquid, or solid, and the agent may be a polynucleotide, protein, peptide, or small molecule. The minoalcohol lipidoid compounds may be combined with other aminoalcohol lipidoid compounds, polymers (synthetic or natural), surfactants, cholesterol, carbohydrates, proteins, lipids, etc. to form the particles. These particles may then optionally be combined with a pharmaceutical excipient to form a pharmaceutical composition.

US Patent Publication No. 0110293703 also provides methods of preparing the aminoalcohol lipidoid compounds. One or more equivalents of an amine are allowed to react with one or more equivalents of an epoxide-terminated compound under suitable conditions to form an aminoalcohol lipidoid compound of the present invention. In certain embodiments, all the amino groups of the amine are fully reacted with the epoxide-terminated compound to form tertiary amines. In other embodiments, all the amino groups of the amine are not fully reacted with the epoxide-terminated compound to form tertiary amines thereby resulting in primary or secondary amines in the aminoalcohol lipidoid compound. These primary or secondary amines are left as is or may be reacted with another electrophile such as a different epoxide-terminated compound. As will be appreciated by one skilled in the art, reacting an amine with less than excess of epoxide-terminated compound will result in a plurality of different aminoalcohol lipidoid compounds with various numbers of tails. Certain amines may be fully functionalized with two epoxide-derived compound tails while other molecules will not be completely functionalized with epoxide-derived compound tails. For example, a diamine or polyamine may include one, two, three, or four epoxide-derived compound tails off the various amino moieties of the molecule resulting in primary, secondary, and tertiary amines. In certain embodiments, all the amino groups are not fully functionalized. In certain embodiments, two of the same types of epoxide-terminated compounds are used. In other embodiments, two or more different epoxide-terminated compounds are used. The synthesis of the aminoalcohol lipidoid compounds is performed with or without solvent, and the synthesis may be performed at higher temperatures ranging from 30.-100 C., preferably at approximately 50.-90 C. The prepared aminoalcohol lipidoid compounds may be optionally purified. For example, the mixture of aminoalcohol lipidoid compounds may be purified to yield an aminoalcohol lipidoid compound with a particular number of epoxide-derived compound tails. Or the mixture may be purified to yield a particular stereo- or regioisomer. The aminoalcohol lipidoid compounds may also be alkylated using an alkyl halide (e.g., methyl iodide) or other alkylating agent, and/or they may be acylated.

US Patent Publication No. 0110293703 also provides libraries of aminoalcohol lipidoid compounds prepared by the inventive methods. These aminoalcohol lipidoid compounds may be prepared and/or screened using high-throughput techniques involving liquid handlers, robots, microtiter plates, computers, etc. In certain embodiments, the aminoalcohol lipidoid compounds are screened for their ability to transfect polynucleotides or other agents (e.g., proteins, peptides, small molecules) into the cell.

US Patent Publication No. 20130302401 relates to a class of poly(beta-amino alcohols) (PBAAs) has been prepared using combinatorial polymerization. The inventive PBAAs may be used in biotechnology and biomedical applications as coatings (such as coatings of films or multilayer films for medical devices or implants), additives, materials, excipients, non-biofouling agents, micropatterning agents, and cellular encapsulation agents. When used as surface coatings, these PBAAs elicited different levels of inflammation, both in vitro and in vivo, depending on their chemical structures. The large chemical diversity of this class of materials allowed us to identify polymer coatings that inhibit macrophage activation in vitro. Furthermore, these coatings reduce the recruitment of inflammatory cells, and reduce fibrosis, following the subcutaneous implantation of carboxylated polystyrene microparticles. These polymers may be used to form polyelectrolyte complex capsules for cell encapsulation. The invention may also have many other biological applications such as antimicrobial coatings, DNA or siRNA delivery, and stem cell tissue engineering. The teachings of US Patent Publication No. 20130302401 may be applied to the CRISPR Cas system of the present invention.

In another embodiment, lipid nanoparticles (LNPs) are contemplated. In particular, an antitransthyretin small interfering RNA encapsulated in lipid nanoparticles (see, e.g., Coelho et al., N Engl J Med 2013; 369:819-29) may be applied to the CRISPR Cas system of the present invention. Doses of about 0.01 to about 1 mg per kg of body weight administered intravenously are contemplated. Medications to reduce the risk of infusion-related reactions are contemplated, such as dexamethasone, acetaminophen, diphenhydramine or cetirizine, and ranitidine are contemplated. Multiple doses of about 0.3 mg per kilogram every 4 weeks for five doses are also contemplated.

LNPs have been shown to be highly effective in delivering siRNAs to the liver (see, e.g., Tabernero et al., Cancer Discovery, April 2013, Vol. 3, No. 4, pages 363-470) and are therefore contemplated for delivering CRISPR Cas to the liver. A dosage of about four doses of 6 mg/kg of the LNP every two weeks may be contemplated. Tabernero et al. demonstrated that tumor regression was observed after the first 2 cycles of LNPs dosed at 0.7 mg/kg, and by the end of 6 cycles the patient had achieved a partial response with complete regression of the lymph node metastasis and substantial shrinkage of the liver tumors. A complete response was obtained after 40 doses in this patient, who has remained in remission and completed treatment after receiving doses over 26 months. Two patients with RCC and extrahepatic sites of disease including kidney, lung, and lymph nodes that were progressing following prior therapy with VEGF pathway inhibitors had stable disease at all sites for approximately 8 to 12 months, and a patient with PNET and liver metastases continued on the extension study for 18 months (36 doses) with stable disease.

However, the charge of the LNP must be taken into consideration. As cationic lipids combined with negatively charged lipids to induce nonbilayer structures that facilitate intracellular delivery. Because charged LNPs are rapidly cleared from circulation following intravenous injection, ionizable cationic lipids with pKa values below 7 were developed (see, e.g., Rosin et al, Molecular Therapy, vol. 19, no. 12, pages 1286-2200, December 2011). Negatively charged polymers such as siRNA oligonucleotides may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-dilineoyl-3-dimethylammonium-propane (DLinDAP), 1,2-dilinoleyloxy-3-N,N-dimethylaminopropane (DLinDMA), 1,2-dilinoleyloxy-keto-N,N-dimethyl-3-aminopropane (DLinKDMA), and 1,2-dilinoleyl-4-(2-dimethylaminoethyl)-[1,3]-dioxolane (DLinKC2-DMA). It has been shown that LNP siRNA systems containing these lipids exhibit remarkably different gene silencing properties in hepatocytes in vivo, with potencies varying according to the series DLinKC2-DMA>DLinKDMA>DLinDMA>> DLin- DAP employing a Factor VII gene silencing model (see, e.g., Rosin et al, Molecular Therapy, vol. 19, no. 12, pages 1286-2200, December 2011). A dosage of 1 µg/ml levels may be contemplated, especially for a formulation containing DLinKC2-DMA.

Preparation of LNPs and CRISPR Cas encapsulation may be used/and or adapted from Rosin et al, Molecular Therapy, vol. 19, no. 12, pages 1286-2200, December 2011). The cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinK-DMA), 1,2-dilinoleyl-4-(2-dimethylaminoethyl)-[1,3]-dioxolane (DLinKC2-DMA), (3-o-[2"-(methoxypolyethyleneglycol 2000) succinoyl]-1,2-dimyristoyl-sn-glycol (PEG-S-DMG), and R-3-[(ω-methoxy-poly(ethylene glycol)2000) carbamoyl]-1,2-dimyristyloxlpropyl-3-amine (PEG-C-DOMG) may be provided by Tekmira Pharmaceuticals (Vancouver, Canada) or synthesized. Cholesterol may be purchased from Sigma (St Louis, Mo.). The specific CRISPR Cas RNA may be encapsulated in LNPs containing DLinDAP, DLinDMA, DLinK-DMA, and DLinKC2-DMA (cationic lipid:DSPC: CHOL: PEGS-DMG or PEG-C-DOMG at 40:10:40:10 molar ratios). When required, 0.2% SP-DiOC18 (Invitrogen, Burlington, Canada) may be incorporated to assess cellular uptake, intracellular delivery, and biodistribution. Encapsulation may be performed by dissolving lipid mixtures comprised of cationic lipid:DSPC:cholesterol:PEG-c-DOMG (40:10:40:10 molar ratio) in ethanol to a final lipid concentration of 10 mmol/l. This ethanol solution of lipid may be added drop-wise to 50 mmol/l citrate, pH 4.0 to form multilamellar vesicles to produce a final concentration of 30% ethanol vol/vol. Large unilamellar vesicles may be formed following extrusion of multilamellar vesicles through two stacked 80 nm Nuclepore polycarbonate filters using the Extruder (Northern Lipids, Vancouver, Canada). Encapsulation may be achieved by adding RNA dissolved at 2 mg/ml in 50 mmol/l citrate, pH 4.0 containing 30% ethanol vol/vol drop-wise to extruded preformed large unilamellar vesicles and incubation at 31° C. for 30 minutes with constant mixing to a final RNA/lipid weight ratio of 0.06/1 wt/wt. Removal of ethanol and neutralization of formulation buffer were performed by dialysis against phosphate-buffered saline (PBS), pH 7.4 for 16 hours using Spectra/Por 2 regenerated cellulose dialysis membranes. Nanoparticle size distribution may be determined by dynamic light scattering using a NICOMP 370 particle sizer, the vesicle/intensity modes, and Gaussian fitting (Nicomp Particle Sizing, Santa Barbara, Calif.). The particle size for all three LNP systems may be ~70 nm in diameter. siRNA encapsulation efficiency may be determined by removal of free siRNA using VivaPureD MiniH columns (Sartorius Stedim Biotech) from samples collected before and after dialysis. The encapsulated RNA may be extracted from the eluted nanoparticles and quantified at 260 nm. siRNA to lipid ratio was determined by measurement of cholesterol content in vesicles using the Cholesterol E enzymatic assay from Wako Chemicals USA (Richmond, Va.).

Preparation of large LNPs may be used/and or adapted from Rosin et al, Molecular Therapy, vol. 19, no. 12, pages 1286-2200, December 2011. A lipid premix solution (20.4 mg/ml total lipid concentration) may be prepared in ethanol containing DLinKC2-DMA, DSPC, and cholesterol at 50:10:38.5 molar ratios. Sodium acetate may be added to the lipid premix at a molar ratio of 0.75:1 (sodium acetate: DLinKC2-DMA). The lipids may be subsequently hydrated by combining the mixture with 1.85 volumes of citrate buffer (10 mmol/l, pH 3.0) with vigorous stirring, resulting in spontaneous liposome formation in aqueous buffer containing 35% ethanol. The liposome solution may be incubated at 37° C. to allow for time-dependent increase in particle size. Aliquots may be removed at various times during incubation to investigate changes in liposome size by dynamic light scattering (Zetasizer Nano ZS, Malvern Instruments, Worcestershire, UK). Once the desired particle size is achieved, an aqueous PEG lipid solution (stock=10 mg/ml PEG-DMG in 35% (vol/vol) ethanol) may be added to the liposome mixture to yield a final PEG molar concentration of 3.5% of total lipid. Upon addition of PEG-lipids, the liposomes should their size, effectively quenching further growth. RNA may then be added to the empty liposomes at an siRNA to total lipid ratio of approximately 1:10 (wt:wt), followed by incubation for 30 minutes at 37° C. to form loaded LNPs. The mixture may be subsequently dialyzed overnight in PBS and filtered with a 0.45-µm syringe filter.

Spherical Nucleic Acid (SNA™) constructs and other nanoparticles (particularly gold nanoparticles) are also contemplate as a means to delivery CRISPR/Cas system to intended targets. Significant data show that AuraSense Therapeutics' Spherical Nucleic Acid (SNA™) constructs, based upon nucleic acid-functionalized gold nanoparticles, are superior to alternative platforms based on multiple key success factors, such as:

High in vivo stability. Due to their dense loading, a majority of cargo (DNA or siRNA) remains bound to the constructs inside cells, conferring nucleic acid stability and resistance to enzymatic degradation.

Deliverability. For all cell types studied (e.g., neurons, tumor cell lines, etc.) the constructs demonstrate a transfection efficiency of 99% with no need for carriers or transfection agents.

Therapeutic targeting. The unique target binding affinity and specificity of the constructs allow exquisite specificity for matched target sequences (i.e., limited off-target effects).

Superior efficacy. The constructs significantly outperform leading conventional transfection reagents (Lipofectamine 2000 and Cytofectin).

Low toxicity. The constructs can enter a variety of cultured cells, primary cells, and tissues with no apparent toxicity.

No significant immune response. The constructs elicit minimal changes in global gene expression as measured by whole-genome microarray studies and cytokine-specific protein assays.

Chemical tailorability. Any number of single or combinatorial agents (e.g., proteins, peptides, small molecules) can be used to tailor the surface of the constructs.

This platform for nucleic acid-based therapeutics may be applicable to numerous disease states, including inflammation and infectious disease, cancer, skin disorders and cardiovascular disease.

Citable literature includes: Cutler et al., J. Am. Chem. Soc. 2011 133:9254-9257, Hao et al., Small. 2011 7:3158-3162, Zhang et al., ACS Nano. 2011 5:6962-6970, Cutler et al., J. Am. Chem. Soc. 2012 134:1376-1391, Young et al., Nano Lett. 2012 12:3867-71, Zheng et al., Proc. Natl. Acad. Sci. USA. 2012 109:11975-80, Mirkin, Nanomedicine 2012 7:635-638 Zhang et al., J. Am. Chem. Soc. 2012 134:16488-1691, Weintraub, Nature 2013 495:S14-S16, Choi et al., Proc. Natl. Acad. Sci. USA. 2013 110(19):7625-7630, Jensen et al., Sci. Transl. Med. 5, 209ra152 (2013) and Mirkin, et al., Small, doi.org/10.1002/smll.201302143.

Self-assembling nanoparticles with siRNA may be constructed with polyethyleneimine (PEI) that is PEGylated with an Arg-Gly-Asp (RGD) peptide ligand attached at the distal end of the polyethylene glycol (PEG), for example, as a means to target tumor neovasculature expressing integrins and used to deliver siRNA inhibiting vascular endothelial growth factor receptor-2 (VEGF R2) expression and thereby tumor angiogenesis (see, e.g., Schiffelers et al., Nucleic Acids Research, 2004, Vol. 32, No. 19). Nanoplexes may be prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. A dosage of about 100 to 200 mg of CRISPR Cas is envisioned for delivery in the self-assembling nanoparticles of Schiffelers et al.

The nanoplexes of Bartlett et al. (PNAS, Sep. 25, 2007, vol. 104, no. 39) may also be applied to the present invention. The nanoplexes of Bartlett et al. are prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. The DOTA-siRNA of Bartlett et al. was synthesized as follows: 1,4,7,10-tetraazacyclododecane-1,4,7,10-tetraacetic acid mono(N-hydroxysuccinimide ester) (DOTA-NHSester) was ordered from Macrocyclics (Dallas, Tex.). The amine modified RNA sense strand with a 100-fold molar excess of DOTA-NHS-ester in carbonate buffer (pH 9) was added to a microcentrifuge tube. The contents were reacted by stirring for 4 h at room temperature. The DOTA-RNAsense conjugate was ethanol-precipitated, resuspended in water, and annealed to the unmodified antisense strand to yield DOTA-siRNA. All liquids were pretreated with Chelex-100 (Bio-Rad, Hercules, Calif.) to remove trace metal contaminants. Tf-targeted and nontargeted siRNA nanoparticles may be formed by using cyclodextrin-containing polycations. Typically, nanoparticles were formed in water at a charge ratio of 3 (+/−) and an siRNA concentration of 0.5 g/liter. One percent of the adamantane-PEG molecules on the surface of the targeted nanoparticles were modified with Tf (adamantane-PEG-Tf). The nanoparticles were suspended in a 5% (wt/vol) glucose carrier solution for injection.

Davis et al. (Nature, Vol 464, 15 Apr. 2010) conducts a siRNA clinical trial that uses a targeted nanoparticle-delivery system (clinical trial registration number NCT00689065). Patients with solid cancers refractory to standard-of-care therapies are administered doses of targeted nanoparticles on days 1, 3, 8 and 10 of a 21-day cycle by a 30-min intravenous infusion. The nanoparticles consist of a synthetic delivery system containing: (1) a linear, cyclodextrin-based polymer (CDP), (2) a human transferrin protein (TF) targeting ligand displayed on the exterior of the nanoparticle to engage TF receptors (TFR) on the surface of the cancer cells, (3) a hydrophilic polymer (polyethylene glycol (PEG) used to promote nanoparticle stability in biological fluids), and (4) siRNA designed to reduce the expression of the RRM2 (sequence used in the clinic was previously denoted siR2B+5). The TFR has long been known to be upregulated in malignant cells, and RRM2 is an established anti-cancer target. These nanoparticles (clinical version denoted as CALAA-01) have been shown to be well tolerated in multi-dosing studies in non-human primates. Although a single patient with chronic myeloid leukaemia has been administered siRNA by liposomal delivery, Davis et al.'s clinical trial is the initial human trial to systemically deliver siRNA with a targeted delivery system and to treat patients with solid cancer. To ascertain whether the targeted delivery system can provide effective delivery of functional siRNA to human tumours, Davis et al. investigated biopsies from three patients from three different dosing cohorts; patients A, B and C, all of whom had metastatic melanoma and received CALAA-01 doses of 18, 24 and 30 mg m$^{-2}$ siRNA, respectively. Similar doses may also be contemplated for the CRISPR Cas system of the present invention. The delivery of the invention may be achieved with nanoparticles containing a linear, cyclodextrin-based polymer (CDP), a human transferrin protein (TF) targeting ligand displayed on the exterior of the nanoparticle to engage TF receptors (TFR) on the surface of the cancer cells and/or a hydrophilic polymer (for example, polyethylene glycol (PEG) used to promote nanoparticle stability in biological fluids).

Exosomes

Exosomes are endogenous nano-vesicles that transport RNAs and proteins which can deliver short interfering (si)RNA to the brain in mice. To reduce immunogenicity, Alvarez-Erviti et al. (2011, Nat Biotechnol 29: 341) used self-derived dendritic cells for exosome production. Targeting was achieved by engineering the dendritic cells to express Lamp2b, an exosomal membrane protein, fused to the neuron-specific RVG peptide3. Purified exosomes were loaded with exogenous siRNA by electroporation. Intravenously injected RVG-targeted exosomes delivered GAPDH siRNA specifically to neurons, microglia, oligodendrocytes in the brain, resulting in a specific gene knockdown. Pre-exposure to RVG exosomes did not attenuate knockdown, and non-specific uptake in other tissues was not observed. The therapeutic potential of exosome-mediated siRNA delivery was demonstrated by the strong mRNA (60%) and protein (62%) knockdown of BACE1, a therapeutic target in Alzheimer's disease.

To obtain a pool of immunologically inert exosomes, Alvarez-Erviti et al. harvested bone marrow from inbred C57BL/6 mice with a homogenous major histocompatibility complex (MHC) haplotype. As immature dendritic cells produce large quantities of exosomes devoid of T-cell activators such as MHC-II and CD86, Alvarez-Erviti et al. selected for dendritic cells with granulocyte/macrophage-colony stimulating factor (GM-CSF) for 7 d. Exosomes were purified from the culture supernatant the following day using well-established ultracentrifugation protocols. The exosomes produced were physically homogenous, with a size distribution peaking at 80 nm in diameter as determined by nanoparticle tracking analysis (NTA) and electron microscopy. Alvarez-Erviti et al. obtained 6-12 µg of exosomes (measured based on protein concentration) per 10$^6$ cells.

Next, Alvarez-Erviti et al. investigated the possibility of loading modified exosomes with exogenous cargoes using electroporation protocols adapted for nanoscale applications. As electroporation for membrane particles at the nanometer scale is not well-characterized, nonspecific Cy5-labeled siRNA was used for the empirical optimization of the electroporation protocol. The amount of encapsulated siRNA was assayed after ultracentrifugation and lysis of exosomes. Electroporation at 400 V and 125 µF resulted in the greatest retention of siRNA and was used for all subsequent experiments.

Alvarez-Erviti et al. administered 150 µg of each BACE1 siRNA encapsulated in 150 µg of RVG exosomes to normal C57BL/6 mice and compared the knockdown efficiency to four controls: untreated mice, mice injected with RVG exosomes only, mice injected with BACE1 siRNA complexed to an in vivo cationic liposome reagent and mice injected with BACE1 siRNA complexed to RVG-9R, the RVG pep tide conjugated to 9 D-arginines that electrostatically binds to the siRNA. Cortical tissue samples were analyzed 3 d after administration and a significant protein knockdown (45%, P<0.05, versus 62%, P<0.01) in both siRNA-RVG-9R-treated and siRNARVG exosome-treated mice was observed, resulting from a significant decrease in BACE1 mRNA levels (66% [+ or −] 15%, P<0.001 and 61% [+ or −] 13% respectively, P<0.01). Moreover, Applicants demonstrated a significant decrease (55%, P<0.05) in the total [beta]-amyloid 1-42 levels, a main component of the amyloid plaques in Alzheimer's pathology, in the RVG-exosome-treated animals. The decrease observed was greater than the β-amyloid 1-40 decrease demonstrated in normal mice after intraventricular injection of BACE1 inhibitors. Alvarez-Erviti et al. carried out 5'-rapid amplification of cDNA ends (RACE) on BACE1 cleavage product, which provided evidence of RNAi-mediated knockdown by the siRNA.

Finally, Alvarez-Erviti et al. investigated whether siRNA-RVG exosomes induced immune responses in vivo by assessing IL-6, IP-10, TNFα and IFN-α serum concentrations. Following siRNA-RVG exosome treatment, nonsignificant changes in all cytokines were registered similar to siRNA-transfection reagent treatment in contrast to siRNA-RVG-9R, which potently stimulated IL-6 secretion, confirming the immunologically inert profile of the exosome treatment. Given that exosomes encapsulate only 20% of siRNA, delivery with RVG-exosome appears to be more efficient than RVG-9R delivery as comparable mRNA knockdown and greater protein knockdown was achieved with fivefold less siRNA without the corresponding level of immune stimulation. This experiment demonstrated the therapeutic potential of RVG-exosome technology, which is potentially suited for long-term silencing of genes related to neurodegenerative diseases. The exosome delivery system of Alvarez-Erviti et al. may be applied to deliver the CRISPR-Cas system of the present invention to therapeutic targets, especially neurodegenerative diseases. A dosage of about 100 to 1000 mg of CRISPR Cas encapsulated in about 100 to 1000 mg of RVG exosomes may be contemplated for the present invention.

El-Andaloussi et al. (Nature Protocols 7, 2112-2126 (2012)) discloses how exosomes derived from cultured cells can be harnessed for delivery of siRNA in vitro and in vivo. This protocol first describes the generation of targeted exosomes through transfection of an expression vector, comprising an exosomal protein fused with a peptide ligand. Next, El-Andaloussi et al. explain how to purify and characterize exosomes from transfected cell supernatant. Next, El-Andaloussi et al. detail crucial steps for loading siRNA into exosomes. Finally, El-Andaloussi et al. outline how to use exosomes to efficiently deliver siRNA in vitro and in vivo in mouse brain. Examples of anticipated results in which exosome-mediated siRNA delivery is evaluated by functional assays and imaging are also provided. The entire protocol takes ~3 weeks. Delivery or administration according to the invention may be performed using exosomes produced from self-derived dendritic cells.

In another embodiment, the plasma exosomes of Wahlgren et al. (Nucleic Acids Research, 2012, Vol. 40, No. 17 e130) are contemplated. Exosomes are nano-sized vesicles (30-90 nm in size) produced by many cell types, including dendritic cells (DC), B cells, T cells, mast cells, epithelial cells and tumor cells. These vesicles are formed by inward budding of late endosomes and are then released to the extracellular environment upon fusion with the plasma membrane. Because exosomes naturally carry RNA between cells, this property might be useful in gene therapy.

Exosomes from plasma are prepared by centrifugation of buffy coat at 900 g for 20 min to isolate the plasma followed by harvesting cell supernatants, centrifuging at 300 g for 10 min to eliminate cells and at 16 500 g for 30 min followed by filtration through a 0.22 mm filter. Exosomes are pelleted by ultracentrifugation at 120 000 g for 70 min. Chemical transfection of siRNA into exosomes is carried out according to the manufacturer's instructions in RNAi Human/Mouse Starter Kit (Quiagen, Hilden, Germany). siRNA is added to 100 ml PBS at a final concentration of 2 mmol/ml. After adding HiPerFect transfection reagent, the mixture is incubated for 10 min at RT. In order to remove the excess of micelles, the exosomes are re-isolated using aldehyde/sulfate latex beads. The chemical transfection of CRISPR Cas into exosomes may be conducted similarly to siRNA. The exosomes may be co-cultured with monocytes and lymphocytes isolated from the peripheral blood of healthy donors. Therefore, it may be contemplated that exosomes containing CRISPR Cas may be introduced to monocytes and lymphocytes of and autologously reintroduced into a human. Accordingly, delivery or administration according to the invention may be performed using plasma exosomes.

Liposomes

Delivery or administration according to the invention can be performed with liposomes. Liposomes are spherical vesicle structures composed of a uni- or multilamellar lipid bilayer surrounding internal aqueous compartments and a relatively impermeable outer lipophilic phospholipid bilayer. Liposomes have gained considerable attention as drug delivery carriers because they are biocompatible, non-toxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi:10.1155/2011/469679 for review).

Liposomes can be made from several different types of lipids; however, phospholipids are most commonly used to generate liposomes as drug carriers. Although liposome formation is spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi:10.1155/2011/469679 for review).

Several other additives may be added to liposomes in order to modify their structure and properties. For instance, either cholesterol or sphingomyelin may be added to the liposomal mixture in order to help stabilize the liposomal structure and to prevent the leakage of the liposomal inner cargo. Further, liposomes are prepared from hydrogenated egg phosphatidylcholine or egg phosphatidylcholine, cholesterol, and dicetyl phosphate, and their mean vesicle sizes were adjusted to about 50 and 100 nm. (see, e.g., Spuch and Navarro, Journal of Drug Delivery, vol. 2011, Article ID 469679, 12 pages, 2011. doi:10.1155/2011/469679 for review).

Conventional liposome formulation is mainly comprised of natural phospholipids and lipids such as 1,2-distearoryl-sn-glycero-3-phosphatidyl choline (DSPC), sphingomyelin, egg phosphatidylcholines and monosialoganglioside. Since this formulation is made up of phospholipids only, liposomal formulations have encountered many challenges, one of the ones being the instability in plasma. Several attempts to overcome these challenges have been made, specifically in the manipulation of the lipid membrane. One of these attempts focused on the manipulation of cholesterol. Addition of cholesterol to conventional formulations reduces rapid release of the encapsulated bioactive compound into the plasma or 1,2-dioleoyl-sn-glycero-3-phosphoethanolamine (DOPE) increases the stability (see, e.g., Spuch and Navarro, Journal of Drug Delivery, vol. 2011, Article ID 469679, 12 pages, 2011. doi:10.1155/2011/469679 for review).

In a particularly advantageous embodiment, Trojan Horse liposomes (also known as Molecular Trojan Horses) are desirable and protocols may be found at http://cshprotocols.cshlp.org/content/2010/4/pdb.prot5407.long. These particles allow delivery of a transgene to the entire brain after an intravascular injection. Without being bound by limitation, it is believed that neutral lipid particles with specific antibodies conjugated to surface allow crossing of the blood brain barrier via endocytosis. Applicant postulates utilizing Trojan Horse Liposomes to deliver the CRISPR family of nucleases to the brain via an intravascular injection, which would allow whole brain transgenic animals without the need for embryonic manipulation. About 1-5 g of DNA may be contemplated for in vivo administration in liposomes.

In another embodiment, the CRISPR Cas system may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of a specific CRISPR Cas targeted in a SNALP are contemplated. The daily treatment may be over about three days and then weekly for about five weeks. In another embodiment, a specific CRISPR Cas encapsulated SNALP) administered by intravenous injection to at doses of abpit 1 or 2.5 mg/kg are also contemplated (see, e.g., Zimmerman et al., Nature Letters, Vol. 441, 4 May 2006). The SNALP formulation may contain the lipids 3-N-[(wmethoxypoly(ethylene glycol) 2000) carbamoyl]-!,2-dimyristyloxy-propylamine (PEG-C-DMA), 1,2-dilinoleyloxy-N,N-dimethyl-3-aminopropane (DLinDMA), 1,2-distearoyl-sn-glycero-3-phosphocholine (DSPC) and cholesterol, in a 2:40:10:48 molar percent ratio (see, e.g., Zimmerman et al., Nature Letters, Vol. 441, 4 May 2006).

In another embodiment, stable nucleic-acid-lipid particles (SNALPs) have proven to be effective delivery molecules to highly vascularized HepG2-derived liver tumors but not in poorly vascularized HCT-116 derived liver tumors (see, e.g., Li, Gene Therapy (2012) 19, 775-780). The SNALP liposomes may be prepared by formulating D-Lin-DMA and PEG-C-DMA with distearoylphosphatidylcholine (DSPC), Cholesterol and siRNA using a 25:1 lipid/siRNA ratio and a 48/40/10/2 molar ratio of Cholesterol/D-Lin-DMA/DSPC/PEG-C-DMA. The resulted SNALP liposomes are about 80-100 nm in size.

In yet another embodiment, a SNALP may comprise synthetic cholesterol (Sigma-Aldrich, St Louis, Mo., USA), dipalmitoylphosphatidylcholine (Avanti Polar Lipids, Alabaster, Ala., USA), 3-N-[(w-methoxy poly(ethylene glycol) 2000)carbamoyl]-1,2-dimyrestyloxypropylamine, and cationic 1,2-dilinoleyloxy-3-N,Ndimethylaminopropane (see, e.g., Geisbert et al., Lancet 2010; 375: 1896-905). A dosage of about 2 mg/kg total CRISPR Cas per dose administered as, for example, a bolus intravenous infusion may be contemplated.

In yet another embodiment, a SNALP may comprise synthetic cholesterol (Sigma-Aldrich), 1,2-distearoyl-sn-glycero-3-phosphocholine (DSPC; Avanti Polar Lipids Inc.), PEG-cDMA, and 1,2-dilinoleyloxy-3-(N;N-dimethyl)aminopropane (DLinDMA) (see, e.g., Judge, J. Clin. Invest. 119:661-673 (2009)). Formulations used for in vivo studies may comprise a final lipid/RNA mass ratio of about 9:1.

The safety profile of RNAi nanomedicines has been reviewed by Barros and Gollob of Alnylam Pharmaceuticals (see, e.g., Advanced Drug Delivery Reviews 64 (2012) 1730-1737). The stable nucleic acid lipid particle (SNALP) is comprised of four different lipids—an ionizable lipid (DLinDMA) that is cationic at low pH, a neutral helper lipid, cholesterol, and a diffusible polyethylene glycol (PEG)-lipid. The particle is approximately 80 nm in diameter and is charge-neutral at physiologic pH. During formulation, the ionizable lipid serves to condense lipid with the anionic siRNA during particle formation. When positively charged under increasingly acidic endosomal conditions, the ionizable lipid also mediates the fusion of SNALP with the endosomal membrane enabling release of siRNA into the cytoplasm. The PEG-lipid stabilizes the particle and reduces aggregation during formulation, and subsequently provides a neutral hydrophilic exterior that improves pharmacokinetic properties.

To date, two clinical programs have been initiated using SNALPsiRNA formulations. Tekmira Pharmaceuticals recently completed a phase I single-dose study of SNALP-ApoB in adult volunteers with elevated LDL cholesterol. ApoB is predominantly expressed in the liver and jejunum and is essential for the assembly and secretion of VLDL and LDL. Seventeen subjects received a single dose of SNALP-ApoB (dose escalation across 7 dose levels). There was no evidence of liver toxicity (anticipated as the potential dose-limiting toxicity based on preclinical studies). One (of two) subjects at the highest dose experienced flu-like symptoms consistent with immune system stimulation, and the decision was made to conclude the trial.

Alnylam Pharmaceuticals has similarly advanced ALN-TTR01, which employs the SNALP technology described above and targets hepatocyte production of both mutant and wild-type TTR to treat TTR amyloidosis (ATTR). Three ATTR syndromes have been described: familial amyloidotic polyneuropathy (FAP) and familial amyloidotic cardiomyopathy (FAC) both caused by autosomal dominant mutations in TTR; and senile systemic amyloidosis (SSA) cause by wildtype TTR. A placebo-controlled, single dose-escalation phase I trial of ALN-TTR01 was recently completed in patients with ATTR. ALN-TTR01 was administered as a 15-minute IV infusion to 31 patients (23 with study drug and 8 with placebo) within a dose range of 0.01 to 1.0 mg/kg (based on siRNA). Treatment was well tolerated with no significant increases in liver function tests. Infusion-related reactions were noted in 3 of 23 patients at >0.4 mg/kg; all responded to slowing of the infusion rate and all continued on study. Minimal and transient elevations of serum cytokines IL-6, IP-10 and IL-1ra were noted in two patients at the highest dose of 1 mg/kg (as anticipated from preclinical and NHP studies). Lowering of serum TTR, the expected pharmacodynamics effect of ALN-TTR01, was observed at 1 mg/kg.

In yet another embodiment, a SNALP may be made by solubilizing a cationic lipid, DSPC, cholesterol and PEG-lipid were solubilized in ethanol at a molar ratio of 40:10:40:10, respectively (see, Semple et al., Nature Niotechnology, Volume 28 Number 2 Feb. 2010, pp. 172-177). The lipid mixture was added to an aqueous buffer (50 mM citrate, pH 4) with mixing to a final ethanol and lipid concentration of 30% (vol/vol) and 6.1 mg/ml, respectively, and allowed to equilibrate at 22° C. for 2 min before extrusion. The hydrated lipids were extruded through two stacked 80 nm pore-sized filters (Nuclepore) at 22° C. using a Lipex Extruder (Northern Lipids) until a vesicle diameter of 70-90 nm, as determined by dynamic light scattering analysis, was obtained. This generally required 1-3 passes. The siRNA (solubilized in a 50 mM citrate, pH 4 aqueous solution containing 30% ethanol) was added to the pre-equilibrated (35° C.) vesicles at a rate of ~5 ml/min with mixing. After a final target siRNA/lipid ratio of 0.06 (wt/wt) was reached, the mixture was incubated for a further 30 min at 35° C. to allow vesicle reorganization and encapsulation of the siRNA. The ethanol was then removed and the external buffer replaced with PBS (155 mM NaCl, 3 mM Na2HPO4, 1 mM KH2PO4, pH 7.5) by either dialysis or tangential flow diafiltration. siRNA were encapsulated in SNALP using a controlled step-wise dilution method process. The lipid constituents of KC2-SNALP were DLin-KC2-DMA (cationic lipid), dipalmitoylphosphatidylcholine (DPPC; Avanti Polar Lipids), synthetic cholesterol (Sigma) and PEG-C-DMA used at a molar ratio of 57.1:7.1:34.3:1.4. Upon formation of the loaded particles, SNALP were dialyzed against PBS and filter sterilized through a 0.2 µm filter before use. Mean particle sizes were 75-85 nm and 90-95% of the siRNA was encapsulated within the lipid particles. The final siRNA/lipid ratio in formulations used for in vivo testing was ~0.15 (wt/wt). LNP-siRNA systems containing Factor VII siRNA were diluted to the appropriate concentrations in sterile PBS immediately before use and the formulations were administered intravenously through the lateral tail vein in a total volume of 10 ml/kg. This method may be extrapolated to the CRISPR Cas system of the present invention.

Other Lipids

Other cationic lipids, such as amino lipid 2,2-dilinoleyl-4-dimethylaminoethyl-[1,3]-dioxolane (DLin-KC2-DMA) may be utilized to encapsulate CRISPR Cas similar to SiRNA (see, e.g., Jayaraman, Angew. Chem. Int. Ed. 2012, 51, 8529-8533). A preformed vesicle with the following lipid composition may be contemplated: amino lipid, distearoylphosphatidylcholine (DSPC), cholesterol and (R)-2,3-bis(octadecyloxy) propyl-1-(methoxy poly(ethylene glycol)2000)propylcarbamate (PEG-lipid) in the molar ratio 40/10/40/10, respectively, and a FVII siRNA/total lipid ratio of approximately 0.05 (w/w). To ensure a narrow particle size distribution in the range of 70-90 nm and a low polydispersity index of 0.11_0.04 (n=56), the particles may be extruded up to three times through 80 nm membranes prior to adding the CRISPR Cas RNA. Particles containing the highly potent amino lipid 16 may be used, in which the molar ratio of the four lipid components 16, DSPC, cholesterol and PEG-lipid (50/10/38.5/1.5) which may be further optimized to enhance in vivo activity.

Michael S D Kormann et al. ("Expression of therapeutic proteins after delivery of chemically modified mRNA in mice: Nature Biotechnology, Volume:29, Pages: 154-157 (2011) Published online 9 Jan. 2011) describes the use of lipid envelopes to deliver RNA. Use of lipid envelopes is also preferred in the present invention.

In another embodiment, lipids may be formulated with the CRISPR Cas system of the present invention to form lipid nanoparticles (LNPs). Lipids include, but are not limited to, DLin-KC2-DMA4, C12-200 and colipids disteroylphosphatidyl choline, cholesterol, and PEG-DMG may be formulated with CRISPR Cas instead of siRNA (see, e.g., Novobrantseva, Molecular Therapy—Nucleic Acids (2012) 1, e4; doi:10.1038/mtna.2011.3) using a spontaneous vesicle formation procedure. The component molar ratio may be about 50/10/38.5/1.5 (DLin-KC2-DMA or C12-200/disteroylphosphatidyl choline/cholesterol/PEG-DMG). The final lipid:siRNA weight ratio may be ~12:1 and 9:1 in the case of DLin-KC2-DMA and C12-200 lipid nanoparticles (LNPs), respectively. The formulations may have mean particle diameters of ~80 nm with >90% entrapment efficiency. A 3 mg/kg dose may be contemplated.

Tekmira has a portfolio of approximately 95 patent families, in the U.S. and abroad, that are directed to various aspects of LNPs and LNP formulations (see, e.g., U.S. Pat. Nos. 7,982,027; 7,799,565; 8,058,069; 8,283,333; 7,901,708; 7,745,651; 7,803,397; 8,101,741; 8,188,263; 7,915,399; 8,236,943 and 7,838,658 and European Pat. Nos 0.1766035; 1519714; 1781593 and 1664316), all of which may be used/and or adapted to the present invention.

The CRISPR Cas system may be delivered encapsulated in PLGA Microspheres such as that further described in US published applications 20130252281 and 20130245107 and 20130244279 (assigned to Moderna Therapeutics) which relate to aspects of formulation of compositions comprising modified nucleic acid molecules which may encode a protein, a protein precursor, or a partially or fully processed form of the protein or a protein precursor. The formulation may have a molar ratio 50:10:38.5:1.5-3.0 (cationic lipid:fusogenic lipid:cholesterol:PEG lipid). The PEG lipid may be selected from, but is not limited to PEG-c-DOMG, PEG-DMG. The fusogenic lipid may be DSPC. See also, Schrum et al., Delivery and Formulation of Engineered Nucleic Acids, US published application 20120251618.

Nanomerics' technology addresses bioavailability challenges for a broad range of therapeutics, including low molecular weight hydrophobic drugs, peptides, and nucleic acid based therapeutics (plasmid, siRNA, miRNA). Specific administration routes for which the technology has demonstrated clear advantages include the oral route, transport across the blood-brain-barrier, delivery to solid tumours, as well as to the eye. See, e.g., Mazza et al., 2013, ACS Nano. 2013 Feb. 26; 7(2):1016-26; Uchegbu and Siew, 2013, J Pharm Sci. 102(2):305-10 and Lalatsa et al., 2012, J Control Release. 2012 Jul. 20; 161(2):523-36.

US Patent Publication No. 20050019923 describes cationic dendrimers for delivering bioactive molecules, such as polynucleotide molecules, peptides and polypeptides and/or pharmaceutical agents, to a mammalian body. The dendrimers are suitable for targeting the delivery of the bioactive molecules to, for example, the liver, spleen, lung, kidney or heart. Dendrimers are synthetic 3-dimensional macromolecules that are prepared in a step-wise fashion from simple branched monomer units, the nature and functionality of which can be easily controlled and varied. Dendrimers are synthesised from the repeated addition of building blocks to a multifunctional core (divergent approach to synthesis), or towards a multifunctional core (convergent approach to synthesis) and each addition of a 3-dimensional shell of building blocks leads to the formation of a higher generation of the dendrimers. Polypropylenimine dendrimers start from a diaminobutane core to which is added twice the number of amino groups by a double Michael addition of acrylonitrile to the primary amines followed by the hydrogenation of the nitriles. This results in a doubling of the amino groups. Polypropylenimine dendrimers contain 100% protonable nitrogens and up to 64 terminal amino groups (generation 5, DAB 64). Protonable groups are usually amine groups which are able to accept protons at neutral pH. The use of dendrimers as gene delivery agents has largely focused on the use of the polyamidoamine. and phosphorous containing compounds with a mixture of amine/amide or N—P($O_2$)S as the conjugating units respectively with no work being reported on the use of the lower generation polypropylenimine dendrimers for gene delivery. Polypropylenimine dendrimers have also been studied as pH sensitive controlled release systems for drug delivery and for their encapsulation of guest molecules when chemically modified by peripheral amino acid groups. The cytotoxicity and interaction of polypropylenimine dendrimers with DNA as well as the transfection efficacy of DAB 64 has also been studied.

US Patent Publication No. 20050019923 is based upon the observation that, contrary to earlier reports, cationic dendrimers, such as polypropylenimine dendrimers, display suitable properties, such as specific targeting and low toxicity, for use in the targeted delivery of bioactive molecules, such as genetic material. In addition, derivatives of the cationic dendrimer also display suitable properties for the targeted delivery of bioactive molecules. See also, Bioactive Polymers, US published application 20080267903, which discloses "Various polymers, including cationic polyamine polymers and dendrimeric polymers, are shown to possess anti-proliferative activity, and may therefore be useful for treatment of disorders characterised by undesirable cellular proliferation such as neoplasms and tumours, inflammatory disorders (including autoimmune disorders), psoriasis and atherosclerosis. The polymers may be used alone as active agents, or as delivery vehicles for other therapeutic agents, such as drug molecules or nucleic acids for gene therapy. In such cases, the polymers' own intrinsic anti-tumour activity may complement the activity of the agent to be delivered."

Supercharged Proteins

Supercharged proteins are a class of engineered or naturally occurring proteins with unusually high positive or negative net theoretical charge. Both supernegatively and superpositively charged proteins exhibit a remarkable ability to withstand thermally or chemically induced aggregation. Superpositively charged proteins are also able to penetrate mammalian cells. Associating cargo with these proteins, such as plasmid DNA, siRNA, or other proteins, can enable the functional delivery of these macromolecules into mammalian cells both in vitro and in vivo. David Liu's lab reported the creation and characterization of supercharged proteins in 2007 (Lawrence et al., 2007, Journal of the American Chemical Society 129, 10110-10112).

The nonviral delivery of siRNA and plasmid DNA into mammalian cells are valuable both for research and therapeutic applications (Akinc et al., 2010, Nat. Biotech. 26, 561-569). Purified+36 GFP protein (or other superpositively charged protein) is mixed with siRNAs in the appropriate serum-free media and allowed to complex prior addition to cells. Inclusion of serum at this stage inhibits formation of the supercharged protein-siRNA complexes and reduces the effectiveness of the treatment. The following protocol has been found to be effective for a variety of cell lines (McNaughton et al., 2009, Proc. Natl. Acad. Sci. USA 106, 6111-6116). However, pilot experiments varying the dose of protein and siRNA should be performed to optimize the procedure for specific cell lines.

(1) One day before treatment, plate $1 \times 10^5$ cells per well in a 48-well plate.

(2) On the day of treatment, dilute purified +36 GFP protein in serumfree media to a final concentration 200 nM. Add siRNA to a final concentration of 50 nM. Vortex to mix and incubate at room temperature for 10 min.

(3) During incubation, aspirate media from cells and wash once with PBS.

(4) Following incubation of +36 GFP and siRNA, add the protein-siRNA complexes to cells.

(5) Incubate cells with complexes at 37 C for 4 h.

(6) Following incubation, aspirate the media and wash three times with 20 U/mL heparin PBS. Incubate cells with serum-containing media for a further 48 h or longer depending upon the assay for knockdown.

(7) Analyze cells by immunoblot, qPCR, phenotypic assay, or other appropriate method.

David Liu's lab has further found +36 GFP to be an effective plasmid delivery reagent in a range of cells. As plasmid DNA is a larger cargo than siRNA, proportionately more +36 GFP protein is required to effectively complex plasmids. For effective plasmid delivery Applicants have developed a variant of +36 GFP bearing a C-terminal HA2 peptide tag, a known endosome-disrupting peptide derived from the influenza virus hemagglutinin protein. The following protocol has been effective in a variety of cells, but as above it is advised that plasmid DNA and supercharged protein doses be optimized for specific cell lines and delivery applications.

(1) One day before treatment, plate $1 \times 10^5$ per well in a 48-well plate.

(2) On the day of treatment, dilute purified þ 36 GFP protein in serumfree media to a final concentration 2 mM. Add 1 mg of plasmid DNA. Vortex to mix and incubate at room temperature for 10 min.

(3) During incubation, aspirate media from cells and wash once with PBS.

(4) Following incubation of þ 36 GFP and plasmid DNA, gently add the protein-DNA complexes to cells.

(5) Incubate cells with complexes at 37 C for 4 h.

(6) Following incubation, aspirate the media and wash with PBS. Incubate cells in serum-containing media and incubate for a further 24-48 h.

(7) Analyze plasmid delivery (e.g., by plasmid-driven gene expression) as appropriate.

See also, e.g., McNaughton et al., Proc. Natl. Acad. Sci. USA 106, 6111-6116 (2009); Cronican et al., ACS Chemical Biology 5, 747-752 (2010); Cronican et al., Chemistry & Biology 18, 833-838 (2011); Thompson et al., Methods in Enzymology 503, 293-319 (2012); Thompson, D. B., et al., Chemistry & Biology 19 (7), 831-843 (2012). The methods of the super charged proteins may be used and/or adapted for delivery of the CRISPR Cas system of the present invention.

Cell Penetrating Peptides

In yet another embodiment, cell penetrating peptides (CPPs) are contemplated for the delivery of the CRISPR Cas system. CPPs are short peptides that facilitate cellular uptake of various molecular cargo (from nanosize particles to small chemical molecules and large fragments of DNA). The term "cargo" as used herein includes but is not limited to the group consisting of therapeutic agents, diagnostic probes, peptides, nucleic acids, antisense oligonucleotides, plasmids, proteins, nanoparticles, liposomes, chromophores, small molecules and radioactive materials. In aspects of the invention, the cargo may also comprise any component of the CRISPR Cas system or the entire functional CRISPR Cas system. Aspects of the present invention further provide methods for delivering a desired cargo into a subject comprising: (a) preparing a complex comprising the cell penetrating peptide of the present invention and a desired cargo, and (b) orally, intraarticularly, intraperitoneally, intrathecally, intrarterially, intranasally, intraparenchymally, subcutaneously, intramuscularly, intravenously, dermally, intrarectally, or topically administering the complex to a subject. The cargo is associated with the peptides either through chemical linkage via covalent bonds or through non-covalent interactions.

The function of the CPPs are to deliver the cargo into cells, a process that commonly occurs through endocytosis with the cargo delivered to the endosomes of living mammalian cells. Cell-penetrating peptides are of different sizes, amino acid sequences, and charges but all CPPs have one distinct characteristic, which is the ability to translocate the plasma membrane and facilitate the delivery of various molecular cargoes to the cytoplasm or an organelle. CPP translocation may be classified into three main entry mechanisms: direct penetration in the membrane, endocytosis-mediated entry, and translocation through the formation of a transitory structure. CPPs have found numerous applications in medicine as drug delivery agents in the treatment of different diseases including cancer and virus inhibitors, as well as contrast agents for cell labeling. Examples of the latter include acting as a carrier for GFP, MIII contrast agents, or quantum dots. CPPs hold great potential as in vitro and in vivo delivery vectors for use in research and medicine. CPPs typically have an amino acid composition that either contains a high relative abundance of positively charged amino acids such as lysine or arginine or has sequences that contain an alternating pattern of polar/charged amino acids and non-polar, hydrophobic amino acids. These two types of structures are referred to as polycationic or amphipathic, respectively. A third class of CPPs are the hydrophobic peptides, containing only apolar residues, with low net charge or have hydrophobic amino acid groups that are crucial for cellular uptake. One of the initial CPPs discovered was the trans-activating transcriptional activator (Tat) from Human Immunodeficiency Virus 1 (HIV-1) which was found to be efficiently taken up from the surrounding media by numerous cell types in culture. Since then, the number of known CPPs has expanded considerably and small molecule synthetic analogues with more effective protein transduction properties have been generated. CPPs include but are not limited to Penetratin, Tat (48-60), Transportan, and (R-AhX-$R_4$) (Ahx=aminohexanoyl).

As described in U.S. Pat. No. 8,372,951, there is provided a CPP derived from eosinophil cationic protein (ECP) which exhibits highly cell-penetrating efficiency and low toxicity. Aspects of delivering the CPP with its cargo into a vertebrate subject are also provided. Further aspects of CPPs and their delivery are described in U.S. Pat. Nos. 8,575,305; 8,614,194 and 8,044,019.

That CPPs can be employed to deliver the CRISPR-Cas system is also provided in the manuscript "Gene disruption by cell-penetrating peptide-mediated delivery of Cas9 protein and guide RNA", by Suresh Ramakrishna, Abu-Bonsrah Kwaku Dad, Jagadish Beloor, et al. Genome Res. 2014 Apr. 2. [Epub ahead of print], incorporated by reference in its entirety, wherein it is demonstrated that treatment with CPP-conjugated recombinant Cas9 protein and CPP-complexed guide RNAs lead to endogenous gene disruptions in human cell lines. In the paper the Cas9 protein was conjugated to CPP via a thioether bond, whereas the guide RNA was complexed with CPP, forming condensed, positively charged nanoparticles. It was shown that simultaneous and sequential treatment of human cells, including embryonic stem cells, dermal fibroblasts, HEK293T cells, HeLa cells, and embryonic carcinoma cells, with the modified Cas9 and guide RNA led to efficient gene disruptions with reduced off-target mutations relative to plasmid transfections.

Implantable Devices

In another embodiment, implantable devices are also contemplated for delivery of the CRISPR Cas system. For example, US Patent Publication 20110195123 discloses an implantable medical device which elutes a drug locally and in prolonged period is provided, including several types of such a device, the treatment modes of implementation and methods of implantation. The device comprising of polymeric substrate, such as a matrix for example, that is used as the device body, and drugs, and in some cases additional scaffolding materials, such as metals or additional polymers, and materials to enhance visibility and imaging. The selection of drug is based on the advantageous of releasing drug locally and in prolonged period, where drug is released directly to the extracellular matrix (ECM) of the diseased area such as tumor, inflammation, degeneration or for symptomatic objectives, or to injured smooth muscle cells, or for prevention. One kind of drug is the gene silencing drugs based on RNA interference (RNAi), including but not limited to si RNA, sh RNA, or antisense RNA/DNA, ribozyme and nucleoside analogs. Therefore, this system may be used/and or adapted to the CRISPR Cas system of the present invention. The modes of implantation in some embodiments are existing implantation procedures that are developed and used today for other treatments, including brachytherapy and needle biopsy. In such cases the dimensions of the new implant described in this invention are similar to the original implant. Typically a few devices are implanted during the same treatment procedure.

As described in US Patent Publication 20110195123, there is provided a drug delivery implantable or insertable system, including systems applicable to a cavity such as the abdominal cavity and/or any other type of administration in which the drug delivery system is not anchored or attached, comprising a biostable and/or degradable and/or bioabsorbable polymeric substrate, which may for example optionally be a matrix. It should be noted that the term "insertion" also includes implantation. The drug delivery system is preferably implemented as a "Loder" as described in US Patent Publication 20110195123.

The polymer or plurality of polymers are biocompatible, incorporating an agent and/or plurality of agents, enabling the release of agent at a controlled rate, wherein the total volume of the polymeric substrate, such as a matrix for example, in some embodiments is optionally and preferably no greater than a maximum volume that permits a therapeutic level of the agent to be reached. As a non-limiting example, such a volume is preferably within the range of 0.1 $m^3$ to 1000 $mm^3$, as required by the volume for the agent load. The Loder may optionally be larger, for example when incorporated with a device whose size is determined by functionality, for example and without limitation, a knee joint, an intra-uterine or cervical ring and the like.

The drug delivery system (for delivering the composition) is designed in some embodiments to preferably employ degradable polymers, wherein the main release mechanism is bulk erosion; or in some embodiments, non degradable, or slowly degraded polymers are used, wherein the main release mechanism is diffusion rather than bulk erosion, so that the outer part functions as membrane, and its internal part functions as a drug reservoir, which practically is not affected by the surroundings for an extended period (for example from about a week to about a few months). Combinations of different polymers with different release mechanisms may also optionally be used. The concentration gradient at the surface is preferably maintained effectively constant during a significant period of the total drug releasing period, and therefore the diffusion rate is effectively constant (termed "zero mode" diffusion). By the term "constant" it is meant a diffusion rate that is preferably maintained above the lower threshold of therapeutic effectiveness, but which may still optionally feature an initial burst and/or fluctuate, for example increasing and decreasing to a certain degree. The diffusion rate is preferably so maintained for a prolonged period, and it can be considered constant to a certain level to optimize the therapeutically effective period, for example the effective silencing period.

The drug delivery system optionally and preferably is designed to shield the nucleotide based therapeutic agent from degradation, whether chemical in nature or due to attack from enzymes and other factors in the body of the subject.

The drug delivery system as described in US Patent Publication 20110195123 is optionally associated with sensing and/or activation appliances that are operated at and/or after implantation of the device, by non and/or minimally invasive methods of activation and/or acceleration/deceleration, for example optionally including but not limited to thermal heating and cooling, laser beams, and ultrasonic, including focused ultrasound and/or RF (radiofrequency) methods or devices.

According to some embodiments of US Patent Publication 20110195123, the site for local delivery may optionally include target sites characterized by high abnormal proliferation of cells, and suppressed apoptosis, including tumors, active and or chronic inflammation and infection including autoimmune diseases states, degenerating tissue including muscle and nervous tissue, chronic pain, degenerative sites, and location of bone fractures and other wound locations for enhancement of regeneration of tissue, and injured cardiac, smooth and striated muscle. The site for local delivery also may optionally include sites enabling performing preventive activities including pregnancy, prevention of infection and aging.

The site for implantation of the composition, or target site, preferably features a radius, area and/or volume that is sufficiently small for targeted local delivery. For example, the target site optionally has a diameter in a range of from about 0.1 mm to about 5 cm.

The location of the target site is preferably selected for maximum therapeutic efficacy. For example, the composition of the drug delivery system (optionally with a device for implantation as described above) is optionally and preferably implanted within or in the proximity of a tumor environment, or the blood supply associated thereof.

For example the composition (optionally with the device) is optionally implanted within or in the proximity to pancreas, prostate, breast, liver, via the nipple, within the vascular system and so forth.

The target location is optionally selected from the group consisting of (as non-limiting examples only, as optionally any site within the body may be suitable for implanting a Loder): 1. brain at degenerative sites like in Parkinson or Alzheimer disease at the basal ganglia, white and gray matter; 2. spine as in the case of amyotrophic lateral sclerosis (ALS); 3. uterine cervix to prevent HPV infection; 4. active and chronic inflammatory joints; 5. dermis as in the case of psoriasis; 6. sympathetic and sensoric nervous sites for analgesic effect; 7. Intra osseous implantation; 8. acute and chronic infection sites; 9. Intra vaginal; 10. Inner ear—auditory system, labyrinth of the inner ear, vestibular system; 11. Intra tracheal; 12. Intra-cardiac; coronary, epicardiac; 13. urinary bladder; 14. biliary system; 15. parenchymal tissue including and not limited to the kidney, liver, spleen; 16. lymph nodes; 17. salivary glands; 18. dental gums; 19. Intra-articular (into joints); 20. Intra-ocular; 21. Brain tissue; 22. Brain ventricles; 23. Cavities, including abdominal cavity (for example but without limitation, for ovary cancer); 24. Intra esophageal and 25. Intra rectal.

Optionally insertion of the system (for example a device containing the composition) is associated with injection of material to the ECM at the target site and the vicinity of that site to affect local pH and/or temperature and/or other biological factors affecting the diffusion of the drug and/or drug kinetics in the ECM, of the target site and the vicinity of such a site.

Optionally, according to some embodiments, the release of said agent could be associated with sensing and/or activation appliances that are operated prior and/or at and/or after insertion, by non and/or minimally invasive and/or else methods of activation and/or acceleration/deceleration, including laser beam, radiation, thermal heating and cooling, and ultrasonic, including focused ultrasound and/or RF (radiofrequency) methods or devices, and chemical activators.

According to other embodiments of US Patent Publication 20110195123, the drug preferably comprises a gene silencing biological RNAi drug, for example for localized cancer cases in breast, pancreas, brain, kidney, bladder, lung, and prostate as described below. Moreover, many drugs other than siRNA are applicable to be encapsulated in Loder, and can be used in association with this invention, as long as such drugs can be encapsulated with the Loder substrate, such as a matrix for example. Such drugs include approved drugs that are delivered today by methods other than of this invention, including Amphotericin B for fungal infection; antibiotics such as in osteomyelitis; pain killers such as narcotics; anti degenerative such as in Alzheimer or Parkinson diseases in a Loder implanted in the vicinity of the spine in the case of back pain. Such a system may be used and/or adapted to deliver the CRISPR Cas system of the present invention.

For example, for specific applications such as prevention of growth or regrowth of smooth muscle cells (that are injured during a stenting procedure and as a result tend to proliferate), the drug may optionally be siRNA that silence smooth muscle cells, including H19 silencing, or a drug selected from the group consisting of taxol, rapamycin and rapamycin-analogs. In such cases the Loder is preferably either a Drug Eluting Stent (DES), with prolonged release at constant rate, or a dedicated device that is implanted separately, in association to the stent. All of this may be used/and or adapted to the CRISPR Cas system of the present invention.

As another example of a specific application, neuro and muscular degenerative diseases develop due to abnormal gene expression. Local delivery of silencing RNAs may have therapeutic properties for interfering with such abnormal gene expression. Local delivery of anti apoptotic, anti inflammatory and anti degenerative drugs including small drugs and macromolecules may also optionally be therapeutic. In such cases the Loder is applied for prolonged release at constant rate and/or through a dedicated device that is implanted separately. All of this may be used and/or adapted to the CRISPR Cas system of the present invention.

As yet another example of a specific application, psychiatric and cognitive disorders are treated with gene modifiers. Gene knockdown with silencing RNA is a treatment option. Loders locally delivering nucleotide based agents to central nervous system sites are therapeutic options for psychiatric and cognitive disorders including but not limited to psychosis, bi-polar diseases, neurotic disorders and behavioral maladies. The Loders could also deliver locally drugs including small drugs and macromolecules upon implantation at specific brain sites. All of this may be used and/or adapted to the CRISPR Cas system of the present invention.

As another example of a specific application, silencing of innate and/or adaptive immune mediators at local sites enables the prevention of organ transplant rejection. Local delivery of silencing RNAs and immunomodulating reagents with the Loder implanted into the transplanted organ and/or the implanted site renders local immune suppression by repelling immune cells such as CD8 activated against the transplanted organ. All of this may be used/and or adapted to the CRISPR Cas system of the present invention.

As another example of a specific application, vascular growth factors including VEGFs and angiogenin and others are essential for neovascularization. Local delivery of the factors, peptides, peptidomimetics, or suppressing their repressors is an important therapeutic modality; silencing the repressors and local delivery of the factors, peptides, macromolecules and small drugs stimulating angiogenesis with the Loder is therapeutic for peripheral, systemic and cardiac vascular disease.

The method of insertion, such as implantation, may optionally already be used for other types of tissue implantation and/or for insertions and/or for sampling tissues, optionally without modifications, or alternatively optionally only with non-major modifications in such methods. Such methods optionally include but are not limited to brachytherapy methods, biopsy, endoscopy with and/or without ultrasound, such as ERCP, stereotactic methods into the brain tissue, Laparoscopy, including implantation with a laparoscope into joints, abdominal organs, the bladder wall and body cavities.

CRISPR Enzyme mRNA and Guide RNA

CRISPR enzyme mRNA and guide RNA might also be delivered separately. CRISPR enzyme mRNA can be delivered prior to the guide RNA to give time for CRISPR enzyme to be expressed. CRISPR enzyme mRNA might be administered 1-12 hours (preferably around 2-6 hours) prior to the administration of guide RNA.

Alternatively, CRISPR enzyme mRNA and guide RNA can be administered together. Advantageously, a second booster dose of guide RNA can be administered 1-12 hours (preferably around 2-6 hours) after the initial administration of CRISPR enzyme mRNA+guide RNA.

Additional administrations of CRISPR enzyme mRNA and/or guide RNA might be useful to achieve the most efficient levels of genome modification.

For minimization of toxicity and off-target effect, it will be important to control the concentration of CRISPR enzyme mRNA and guide RNA delivered. Optimal concentrations of CRISPR enzyme mRNA and guide RNA can be determined by testing different concentrations in a cellular or animal model and using deep sequencing the analyze the extent of modification at potential off-target genomic loci. For example, for the guide sequence targeting 5'-GAGTC-CGAGCAGAAGAAGAA-3' (SEQ ID NO: 36) in the EMX1 gene of the human genome, deep sequencing can be used to assess the level of modification at the following two off-target loci, 1: 5'-GAGTCCTAGCAGGAGAAGAA-3' (SEQ ID NO: 37) and 2: 5'-GAGTCTAAGCA-GAAGAAGAA-3' (SEQ ID NO: 38). The concentration that gives the highest level of on-target modification while minimizing the level of off-target modification should be chosen for in vivo delivery.

Crystallization of CRISPR-Cas9 and Characterization of Crystal Structure

The crystals of the invention can be obtained by techniques of protein crystallography, including batch, liquid bridge, dialysis, vapor diffusion and hanging drop methods. Generally, the crystals of the invention are grown by dissolving substantially pure CRISPR-Cas9 and a nucleic acid molecule to which it binds in an aqueous buffer containing a precipitant at a concentration just below that necessary to precipitate. Water is removed by controlled evaporation to produce precipitating conditions, which are maintained until crystal growth ceases.

Uses of the Crystals, Crystal Structure and Atomic Structure Co-Ordinates: The crystals of the invention, and particularly the atomic structure co-ordinates obtained therefrom, have a wide variety of uses. The crystals and structure co-ordinates are particularly useful for identifying compounds (nucleic acid molecules) that bind to CRISPR-Cas9, and CRISPR-Cas9s that can bind to particular compounds (nucleic acid molecules). Thus, the structure co-ordinates described herein can be used as phasing models in determining the crystal structures of additional synthetic or mutated CRISPR-Cas9s, Cas9s, nickases, binding domains. The provision of the crystal structure of CRISPR-Cas9 complexed with a nucleic acid molecule as in the herein Crystal Structure Table and the Figures provide the skilled artisan with a detailed insight into the mechanisms of action of CRISPR-Cas9. This insight provides a means to design modified CRISPR-Cas9s, such as by attaching thereto a functional group, such as a repressor or activator. While one can attach a functional group such as a repressor or activator to the N or C terminal of CRISPR-Cas9, the crystal structure demonstrates that the N terminal seems obscured or hidden, whereas the C terminal is more available for a functional group such as repressor or activator. Moreover, the crystal structure demonstrates that there is a flexible loop between approximately CRISPR-Cas9 (*S. pyogenes*) residues 534-676 which is suitable for attachment of a functional group such as an activator or repressor. Attachment can be via a linker, e.g., a flexible glycine-serine (GlyGlyGlySer) (SEQ ID NO: 1) or (GGGS)$_3$ (SEQ ID NO: 13) or a rigid alpha-helical linker such as (Ala(GluAlaAlaAlaLys)Ala) (SEQ ID NO: 2). In addition to the flexible loop there is also a nuclease or H3 region, an H2 region and a helical region. By "helix" or "helical", is meant a helix as known in the art, including, but not limited to an alpha-helix. Additionally, the term helix or helical may also be used to indicate a c-terminal helical element with an N-terminal turn.

The provision of the crystal structure of CRISPR-Cas9 complexed with a nucleic acid molecule allows a novel approach for drug or compound discovery, identification, and design for compounds that can bind to CRISPR-Cas9 and thus the invention provides tools useful in diagnosis, treatment, or prevention of conditions or diseases of multicellular organisms, e.g., algae, plants, invertebrates, fish, amphibians, reptiles, avians, mammals; for example domesticated plants, animals (e.g., production animal such as swine, bovine, chicken; companion animal such as felines, canines, rodents (rabbit, gerbil, hamster); laboratory animals such as mouse, rat), and humans. Accordingly, the invention provides a computer-based method of rational design of CRISPR-Cas9 complexes. This rational design can comprise: providing the structure of the CRISPR-Cas9 complex as defined by some or all (e.g., at least 2 or more, e.g., at least 5, advantageously at least 10, more advantageously at least 50 and even more advantageously at least 100 atoms of the structure) co-ordinates in the herein Crystal Structure Table and/or in Figure(s); providing a structure of a desired nucleic acid molecule as to which a CRISPR-Cas9 complex is desired; and fitting the structure of the CRISPR-Cas9 complex as defined by some or all co-ordinates in the herein Crystal Structure Table and/or in Figures to the desired nucleic acid molecule, including in said fitting obtaining putative modification(s) of the CRISPR-Cas9 complex as defined by some or all co-ordinates in the herein Crystal Structure Table and/or in Figures for said desired nucleic acid molecule to bind for CRISPR-Cas9 complex(es) involving the desired nucleic acid molecule. The method or fitting of the method may use the co-ordinates of atoms of interest of the CRISPR-Cas9 complex as defined by some or all co-ordinates in the herein Crystal Structure Table and/or in Figures which are in the vicinity of the active site or binding region (e.g., at least 2 or more, e.g., at least 5, advantageously at least 10, more advantageously at least 50 and even more advantageously at least 100 atoms of the structure) in order to model the vicinity of the active site or binding region. These co-ordinates may be used to define a space which is then screened "in silico" against a desired or candidate nucleic acid molecule. Thus, the invention provides a computer-based method of rational design of CRISPR-Cas9 complexes. This method may include: providing the co-ordinates of at least two atoms of the herein Crystal Structure Table ("selected co-ordinates"); providing the structure of a candidate or desired nucleic acid molecule; and fitting the structure of the candidate to the selected co-ordinates. In this fashion, the skilled person may also fit a functional group and a candidate or desired nucleic acid molecule. For example, providing the structure of the CRISPR-Cas9 complex as defined by some or all (e.g., at least 2 or more, e.g., at least 5, advantageously at least 10, more advantageously at least 50 and even more advantageously at least 100 atoms of the structure) co-ordinates in the herein Crystal Structure Table and/or in Figure(s); providing a structure of a desired nucleic acid molecule as to which a CRISPR-Cas9 complex is desired; fitting the structure of the CRISPR-Cas9 complex as defined by some or all co-ordinates in the herein Crystal Structure Table and/or in Figures to the desired nucleic acid molecule, including in said fitting obtaining putative modification(s) of the CRISPR-Cas9 complex as defined by some or all co-ordinates in the herein Crystal Structure Table and/or in Figures for said desired nucleic acid molecule to bind for CRISPR-Cas9 complex(es) involving the desired nucleic acid molecule; selecting putative fit CRISPR-Cas9-desired nucleic acid molecule complex(es), fitting such putative fit CRISPR-Cas9-desired nucleic acid molecule complex(es) to the functional group (e.g., activator, repressor), e.g., as to locations for situating the functional group (e.g., positions within the flexible loop) and/or putative modifications of the putative fit CRISPR-Cas9-desired nucleic acid molecule complex(es) for creating locations for situating the functional group. As alluded to, the invention can be practiced using co-ordinates in the herein Crystal Structure Table and/or in Figures which are in the vicinity of the active site or binding region; and therefore, the methods of the invention can employ a sub-domain of interest of the CRISPR-Cas9 complex. Methods of the invention can be practiced using coordinates of a domain or sub-domain. The methods can optionally include synthesizing the candidate or desired nucleic acid molecule and/or the CRISPR-Cas9 systems from the "in silico" output and testing binding and/or activity of "wet" or actual a functional group linked to a "wet" or actual CRISPR-Cas9 system bound to a "wet" or actual candidate or desired nucleic acid molecule. The methods can include synthesizing the CRISPR-Cas9 systems (including a functional group) from the "in silico" output and testing binding and/or activity of "wet" or actual a functional group linked to a "wet" or actual CRISPR-Cas9 system bound to an in vivo "wet" or actual candidate or desired nucleic acid molecule, e.g., contacting "wet" or actual CRISPR-Cas9 system including a functional group from the "in silico" output with a cell containing the desired or candidate nucleic acid molecule. These methods can include observing the cell or an organism containing the cell for a desired reaction, e.g., reduction of symptoms or condition or disease. The step of providing the structure of a candidate nucleic acid molecule may involve selecting the compound by computationally screening a database containing nucleic acid molecule data, e.g., such data as to conditions or diseases. A 3-D descriptor for binding of the candidate nucleic acid molecule may be derived from geometric and functional constraints derived from the architecture and chemical nature of the CRISPR-Cas9 complex or domains or regions thereof from the herein crystal structure. In effect, the descriptor can be a type of virtual modification(s) of the CRISPR-Cas9 complex crystal structure herein for binding CRISPR-Cas9 to the candidate or desired nucleic acid molecule. The descriptor may then be used to interrogate the nucleic acid molecule database to ascertain those nucleic acid molecules of the database that have putatively good binding to the descriptor. The herein "wet" steps can then be performed using the descriptor and nucleic acid molecules that have putatively good binding.

"Fitting" can mean determining, by automatic or semi-automatic means, interactions between at least one atom of the candidate and at least one atom of the CRISPR-Cas9 complex and calculating the extent to which such an interaction is stable. Interactions can include attraction, repulsion, brought about by charge, steric considerations, and the like. A "sub-domain" can mean at least one, e.g., one, two, three, or four, complete element(s) of secondary structure. Particular regions or domains of the CRISPR-Cas9 include those identified in the herein Crystal Structure Table and the Figures.

In any event, the determination of the three-dimensional structure of CRISPR-cas 9 (*S. pyogenes* Cas9) complex provides a basis for the design of new and specific nucleic acid molecules that bind to CRISPR-cas 9 (e.g., *S. pyogenes* Cas9), as well as the design of new CRISPR-Cas9 systems, such as by way of modification of the CRISPR-Cas9 system to bind to various nucleic acid molecules, by way of modification of the CRISPR-Cas9 system to have linked thereto to any one or more of various functional groups that may interact with each other, with the CRISPR-Cas9 (e.g., an inducible system that provides for self-activation and/or self-termination of function), with the nucleic acid molecule nucleic acid molecules (e.g., the functional group may be a regulatory or functional domain which may be selected from the group consisting of a transcriptional repressor, a transcriptional activator, a nuclease domain, a DNA methyl transferase, a protein acetyltransferase, a protein deacetylase, a protein methyltransferase, a protein deaminase, a protein kinase, and a protein phosphatase; and, in some aspects, the functional domain is an epigenetic regulator; see, e.g., Zhang et al., U.S. Pat. No. 8,507,272, and it is again mentioned that it and all documents cited herein and all appln cited documents are hereby incorporated herein by reference), by way of modification of Cas9, by way of novel nickases). Indeed, the herewith CRISPR-Cas9 (*S. pyogenes* Cas9) crystal structure has a multitude of uses. For example, from knowing the three-dimensional structure of CRISPR-Cas9 (*S. pyogenes* Cas9) crystal structure, computer modelling programs may be used to design or identify different molecules expected to interact with possible or confirmed sites such as binding sites or other structural or functional features of the CRISPR-Cas9 system (e.g., *S. pyogenes* Cas9). Compound that potentially bind ("binder") can be examined through the use of computer modeling using a docking program. Docking programs are known; for example GRAM, DOCK or AUTODOCK (see Walters et al. Drug Discovery Today, vol. 3, no. 4 (1998), 160-178, and Dunbrack et al. Folding and Design 2 (1997), 27-42). This procedure can include computer fitting of potential binders ascertain how well the shape and the chemical structure of the potential binder will bind to a CRISPR-Cas9 system (e.g., *S. pyogenes* Cas9). Computer-assisted, manual examination of the active site or binding site of a CRISPR-Cas9 system (e.g., *S. pyogenes* Cas9) may be performed. Programs such as GRID (P. Goodford, J. Med. Chem, 1985, 28, 849-57)—a program that determines probable interaction sites between molecules with various functional groups—may also be used to analyze the active site or binding site to predict partial structures of binding compounds. Computer programs can be employed to estimate the attraction, repulsion or steric hindrance of the two binding partners, e.g., CRISPR-Cas9 system (e.g., *S. pyogenes* Cas9) and a candidate nucleic acid molecule or a nucleic acid molecule and a candidate CRISPR-Cas9 system (e.g., *S. pyogenes* Cas9); and the CRISPR-Cas9 crystal structure (*S. pyogenes* Cas9) herewith enables such methods. Generally, the tighter the fit, the fewer the steric hindrances, and the greater the attractive forces, the more potent the potential binder, since these properties are consistent with a tighter binding constant. Furthermore, the more specificity in the design of a candidate CRISPR-Cas9 system (e.g., *S. pyogenes* Cas9), the more likely it is that it will not interact with off-target molecules as well. Also, "wet" methods are enabled by the instant invention. For example, in an aspect, the invention provides for a method for determining the structure of a binder (e.g., target nucleic acid molecule) of a candidate CRISPR-Cas9 system (e.g., *S. pyogenes* Cas9) bound to the candidate CRISPR-Cas9 system (e.g., *S. pyogenes* Cas9), said method comprising, (a) providing a first crystal of a candidate CRISPR-Cas9 system (*S. pyogenes* Cas9) according to the invention or a second crystal of a candidate a candidate CRISPR-Cas9 system (e.g., *S. pyogenes* Cas9), (b) contacting the first crystal or second crystal with said binder under conditions whereby a complex may form; and (c) determining the structure of said a candidate (e.g., CRISPR-Cas9 system (e.g., *S. pyogenes* Cas9) or CRISPR-Cas9 system (*S. pyogenes* Cas9) complex. The second crystal may have essentially the same coordinates discussed herein, however due to minor alterations in CRISPR-Cas9 system (e.g., from the Cas9 of such a system being e.g., *S. pyogenes* Cas9 versus being *S. pyogenes* Cas9), wherein "e.g., *S. pyogenes* Cas9" indicates that the Cas9 is a Cas9 and can be of or derived from *S. pyogenes* or an ortholog thereof), the crystal may form in a different space group.

The invention further involves, in place of or in addition to "in silico" methods, other "wet" methods, including high throughput screening of a binder (e.g., target nucleic acid molecule) and a candidate CRISPR-Cas9 system (e.g., *S. pyogenes* Cas9), or a candidate binder (e.g., target nucleic acid molecule) and a CRISPR-Cas9 system (e.g., *S. pyogenes* Cas9), or a candidate binder (e.g., target nucleic acid molecule) and a candidate CRISPR-Cas9 system (e.g., *S. pyogenes* Cas9) (the foregoing CRISPR-Cas9 system(s) with or without one or more functional group(s)), to select compounds with binding activity. Those pairs of binder and CRISPR-Cas9 system which show binding activity may be selected and further crystallized with the CRISPR-Cas9 crystal having a structure herein, e.g., by co-crystallization or by soaking, for X-ray analysis. The resulting X-ray structure may be compared with that of the herein Crystal Structure Table and the information in the Figures for a variety of purposes, e.g., for areas of overlap. Having designed, identified, or selected possible pairs of binder and CRISPR-Cas9 system by determining those which have favorable fitting properties, e.g., predicted strong attraction based on the pairs of binder and CRISPR-Cas9 crystal structure data herein, these possible pairs can then be screened by "wet" methods for activity. Consequently, in an aspect the invention can involve: obtaining or synthesizing the possible pairs; and contacting a binder (e.g., target nucleic acid molecule) and a candidate CRISPR-Cas9 system (e.g., *S. pyogenes* Cas9), or a candidate binder (e.g., target nucleic acid molecule) and a CRISPR-Cas9 system (e.g., *S. pyogenes* Cas9), or a candidate binder (e.g., target nucleic acid molecule) and a candidate CRISPR-Cas9 system (e.g., *S. pyogenes* Cas9) (the foregoing CRISPR-Cas9 system(s) with or without one or more functional group(s)) to determine ability to bind. In the latter step, the contacting is advantageously under conditions to determine function. Instead of, or in addition to, performing such an assay, the invention may comprise: obtaining or synthesizing complex(es) from said contacting and analyzing the complex(es), e.g., by X-ray diffraction or NMR or other means, to determine the ability to bind or interact. Detailed structural information can then be obtained about the binding, and in light of this information, adjustments can be made to the structure or functionality of a candidate CRISPR-Cas9 system or components thereof. These steps may be repeated and re-repeated as necessary. Alternatively or additionally, potential CRISPR-Cas9 systems from or in the foregoing methods can be with nucleic acid molecules in vivo, including without limitation by way of administration to an organism (including non-human animal and human) to ascertain or confirm function, including whether a desired outcome (e.g., reduction of symptoms, treatment) results therefrom.

The invention further involves a method of determining three dimensional structures of CRISPR-cas systems or complex(es) of unknown structure by using the structural co-ordinates of the herein Crystal Structure Table and the information in the Figures. For example, if X-ray crystallographic or NMR spectroscopic data are provided for a CRISPR-cas system or complex of unknown crystal structure, the structure of a CRISPR-Cas9 complex as defined in the herein Crystal Structure Table and the Figures may be used to interpret that data to provide a likely structure for the unknown system or complex by such techniques as by phase modeling in the case of X-ray crystallography. Thus, an inventive method can comprise: aligning a representation of the CRISPR-cas system or complex having an unknown crystal structure with an analogous representation of the CRISPR-cas(9) system and complex of the crystal structure herein to match homologous or analogous regions (e.g., homologous or analogous sequences); modeling the structure of the matched homologous or analogous regions (e.g., sequences) of the CRISPR-cas system or complex of unknown crystal structure based on the structure as defined in the herein Crystal Structure Table and/or in the Figures of the corresponding regions (e.g., sequences); and, determining a conformation (e.g. taking into consideration favorable interactions should be formed so that a low energy conformation is formed) for the unknown crystal structure which substantially preserves the structure of said matched homologous regions. "Homologous regions" describes, for example as to amino acids, amino acid residues in two sequences that are identical or have similar, e.g., aliphatic, aromatic, polar, negatively charged, or positively charged, side-chain chemical groups. Homologous regions as of nucleic acid molecules can include at least 85% or 86% or 87% or 88% or 89% or 90% or 91% or 92% or 93% or 94% or 95% or 96% or 97% or 98% or 99% homology or identity. Identical and similar regions are sometimes described as being respectively "invariant" and "conserved" by those skilled in the art. Advantageously, the first and third steps are performed by computer modeling. Homology modeling is a technique that is well known to those skilled in the art (see, e.g., Greer, Science vol. 228 (1985) 1055, and Blundell et al. Eur J Biochem vol 172 (1988), 513). The computer representation of the conserved regions of the CRISPR-Cas9 crystal structure herein and those of a CRISPR-cas system of unknown crystal structure aid in the prediction and determination of the crystal structure of the CRISPR-cas system of unknown crystal structure.

Further still, the aspects of the invention which employ the CRISPR-Cas9 crystal structure in silico may be equally applied to new CRISPR-cas crystal structures divined by using the herein CRISPR-Cas9 crystal structure. In this fashion, a library of CRISPR-cas crystal structures can be obtained. Rational CRISPR-cas system design is thus provided by the instant invention. For instance, having determined a conformation or crystal structure of a CRISPR-cas system or complex, by the methods described herein, such a conformation may be used in a computer-based methods herein for determining the conformation or crystal structure of other CRISPR-cas systems or complexes whose crystal structures are yet unknown. Data from all of these crystal structures can be in a database, and the herein methods can be more robust by having herein comparisons involving the herein crystal structure or portions thereof be with respect to one or more crystal structures in the library. The invention further provides systems, such as computer systems, intended to generate structures and/or perform rational design of a CRISPR-cas system or complex. The system can contain: atomic co-ordinate data according to the herein Crystal Structure Table and the Figures or be derived therefrom e.g., by modeling, said data defining the three-dimensional structure of a CRISPR-cas system or complex or at least one domain or sub-domain thereof, or structure factor data therefor, said structure factor data being derivable from the atomic co-ordinate data of the herein Crystal Structure Table and the Figures. The invention also involves computer readable media with: atomic co-ordinate data according to the herein Crystal Structure Table and/or the Figures or derived therefrom e.g., by homology modeling, said data defining the three-dimensional structure of a CRISPR-cas system or complex or at least one domain or sub-domain thereof, or structure factor data therefor, said structure factor data being derivable from the atomic co-ordinate data of the herein Crystal Structure Table and/or the Figures. "Computer readable media" refers to any media which can be read and accessed directly by a computer, and includes, but is not limited to: magnetic storage media; optical storage media; electrical storage media; cloud storage and hybrids of these categories. By providing such computer readable media, the atomic co-ordinate data can be routinely accessed for modeling or other "in silico" methods. The invention further comprehends methods of doing business by providing access to such computer readable media, for instance on a subscription basis, via the Internet or a global communication/computer network; or, the computer system can be available to a user, on a subscription basis. A "computer system" refers to the hardware means, software means and data storage means used to analyze the atomic co-ordinate data of the present invention. The minimum hardware means of computer-based systems of the invention may comprise a central processing unit (CPU), input means, output means, and data storage means. Desirably, a display or monitor is provided to visualize structure data. The invention further comprehends methods of transmitting information obtained in any method or step thereof described herein or any information described herein, e.g., via telecommunications, telephone, mass communications, mass media, presentations, internet, email, etc. The crystal structures of the invention can be analyzed to generate Fourier electron density map(s) of CRISPR-cas systems or complexes; advantageously, the three-dimensional structure being as defined by the atomic co-ordinate data according to the herein Crystal Structure Table and/or the Figures. Fourier electron density maps can be calculated based on X-ray diffraction patterns. These maps can then be used to determine aspects of binding or other interactions. Electron density maps can be calculated using known programs such as those from the CCP4 computer package (Collaborative Computing Project, No. 4. The CCP4 Suite: Programs for Protein Crystallography, Acta Crystallographica, D50, 1994, 760-763). For map visualization and model building programs such as "QUANTA" (1994, San Diego, Calif.: Molecular Simulations, Jones et al., Acta Crystallography A47 (1991), 110-119) can be used.

The herein Crystal Structure Table (see Example 8) gives atomic co-ordinate data for a CRISPR-Cas9 (*S. pyogenes*), and lists each atom by a unique number; the chemical element and its position for each amino acid residue (as determined by electron density maps and antibody sequence comparisons), the amino acid residue in which the element is located, the chain identifier, the number of the residue, co-ordinates (e.g., X, Y, Z) which define with respect to the crystallographic axes the atomic position (in angstroms) of the respective atom, the occupancy of the atom in the respective position, "B", isotropic displacement parameter (in angstroms$^2$) which accounts for movement of the atom around its atomic center, and atomic number. See also Example 12, the text herein and the Figures.

In particular embodiments of the invention, the conformational variations in the crystal structures of the CRISPR-Cas9 system or of components of the CRISPR-Cas9 provide important and critical information about the flexibility or movement of protein structure regions relative to nucleotide (RNA or DNA) structure regions that may be important for CRISPR-Cas system function. The structural information provided for Cas9 (e.g. *S. pyogenes* Cas9) as the CRISPR enzyme in the present application may be used to further engineer and optimize the CRISPR-Cas system and this may be extrapolated to interrogate structure-function relationships in other CRISPR enzyme systems as well. An aspect of the invention relates to the crystal structure of *S. pyogenes* Cas9 in complex with sgRNA and its target DNA at 2.4 Å resolution. The structure revealed a bilobed architecture composed of target recognition and nuclease lobes, accommodating a sgRNA:DNA duplex in a positively-charged groove at their interface. The recognition lobe is essential for sgRNA and DNA binding and the nuclease lobe contains the HNH and RuvC nuclease domains, which are properly positioned for the cleavage of complementary and non-complementary strands of the target DNA, respectively. This high-resolution structure and the functional analyses provided herein elucidate the molecular mechanism of RNA-guided DNA targeting by Cas9, and provides an abundance of information for generating optimized CRISPR-Cas systems and components thereof.

In particular embodiments of the invention, the crystal structure provides a critical step towards understanding the molecular mechanism of RNA-guided DNA targeting by Cas9. The structural and functional analyses herein provide a useful scaffold for rational engineering of Cas9-based genome modulating technologies and may provide guidance as to Cas9-mediated recognition of PAM sequences on the target DNA or mismatch tolerance between the sgRNA: DNA duplex. Aspects of the invention also relate to truncation mutants, e.g. an S. pyogenes Cas9 truncation mutant may facilitate packaging of Cas9 into size-constrained viral vectors for in vivo and therapeutic applications. Similarly, future engineering of the PAM Interacting (PI) domain may allow programming of PAM specificity, improve target site recognition fidelity, and increase the versatility of the Cas9 genome engineering platform.

The invention comprehends optimized functional CRISPR-Cas enzyme systems. In particular the CRISPR enzyme comprises one or more mutations that converts it to a DNA binding protein to which functional domains exhibiting a function of interest may be recruited or appended or inserted or attached. In certain embodiments, the CRISPR enzyme comprises one or more mutations which include but are not limited to D10A, E762A, H840A, N854A, N863A or D986A (based on the amino acid position numbering of a S. pyogenes Cas9) and/or the one or more mutations is in a RuvC1 or HNH domain of the CRISPR enzyme or is a mutation as otherwise as discussed herein. In some embodiments, the CRISPR enzyme has one or more mutations in a catalytic domain, wherein when transcribed, the tracr mate sequence hybridizes to the tracr sequence and the guide sequence directs sequence-specific binding of a CRISPR complex to the target sequence, and wherein the enzyme further comprises a functional domain.

The structural information provided herein allows for interrogation of sgRNA (or chimeric RNA) interaction with the target DNA and the CRISPR enzyme (e.g. Cas9) permitting engineering or alteration of sgRNA structure to optimize functionality of the entire CRISPR-Cas system. For example, loops of the sgRNA may be extended, without colliding with the Cas9 protein by the insertion of distinct RNA loop(s) or distinct sequence(s) that may recruit adaptor proteins that can bind to the distinct RNA loop(s) or distinct sequence(s). The adaptor proteins may include but are not limited to orthogonal RNA-binding protein/aptamer combinations that exist within the diversity of bacteriophage coat proteins. A list of such coat proteins includes, but is not limited to: Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1. These adaptor proteins or orthogonal RNA binding proteins can further recruit effector proteins or fusions which comprise one or more functional domains. In some embodiments, the functional domain may be selected from the group consisting of: transposase domain, integrase domain, recombinase domain, resolvase domain, invertase domain, protease domain, DNA methyltransferase domain, DNA hydroxylmethylase domain, DNA demethylase domain, histone acetylase domain, histone deacetylases domain, nuclease domain, repressor domain, activator domain, nuclear-localization signal domains, transcription-regulatory protein (or transcription complex recruiting) domain, cellular uptake activity associated domain, nucleic acid binding domain, antibody presentation domain, histone modifying enzymes, recruiter of histone modifying enzymes; inhibitor of histone modifying enzymes, histone methyltransferase, histone demethylase, histone kinase, histone phosphatase, histone ribosylase, histone deribosylase, histone ubiquitinase, histone deubiquitinase, histone biotinase and histone tail protease. In some preferred embodiments, the functional domain is a transcriptional activation domain, preferably VP64. In some embodiments, the functional domain is a transcription repression domain, preferably KRAB. In some embodiments, the transcription repression domain is SID, or concatemers of SID (eg SID4X). In some embodiments, the functional domain is an epigenetic modifying domain, such that an epigenetic modifying enzyme is provided. In some embodiments, the functional domain is an activation domain, which may be the P65 activation domain.

The invention will now be further described by way of the following non-limiting examples.

EXAMPLES

The following examples are given for the purpose of illustrating various embodiments of the invention and are not meant to limit the present invention in any fashion. The present examples, along with the methods described herein are presently representative of preferred embodiments, are exemplary, and are not intended as limitations on the scope of the invention. Changes therein and other uses which are encompassed within the spirit of the invention as defined by the scope of the claims will occur to those skilled in the art.

Example 1: CRISPR Complex Activity in the Nucleus of a Eukaryotic Cell

Figure 2A:
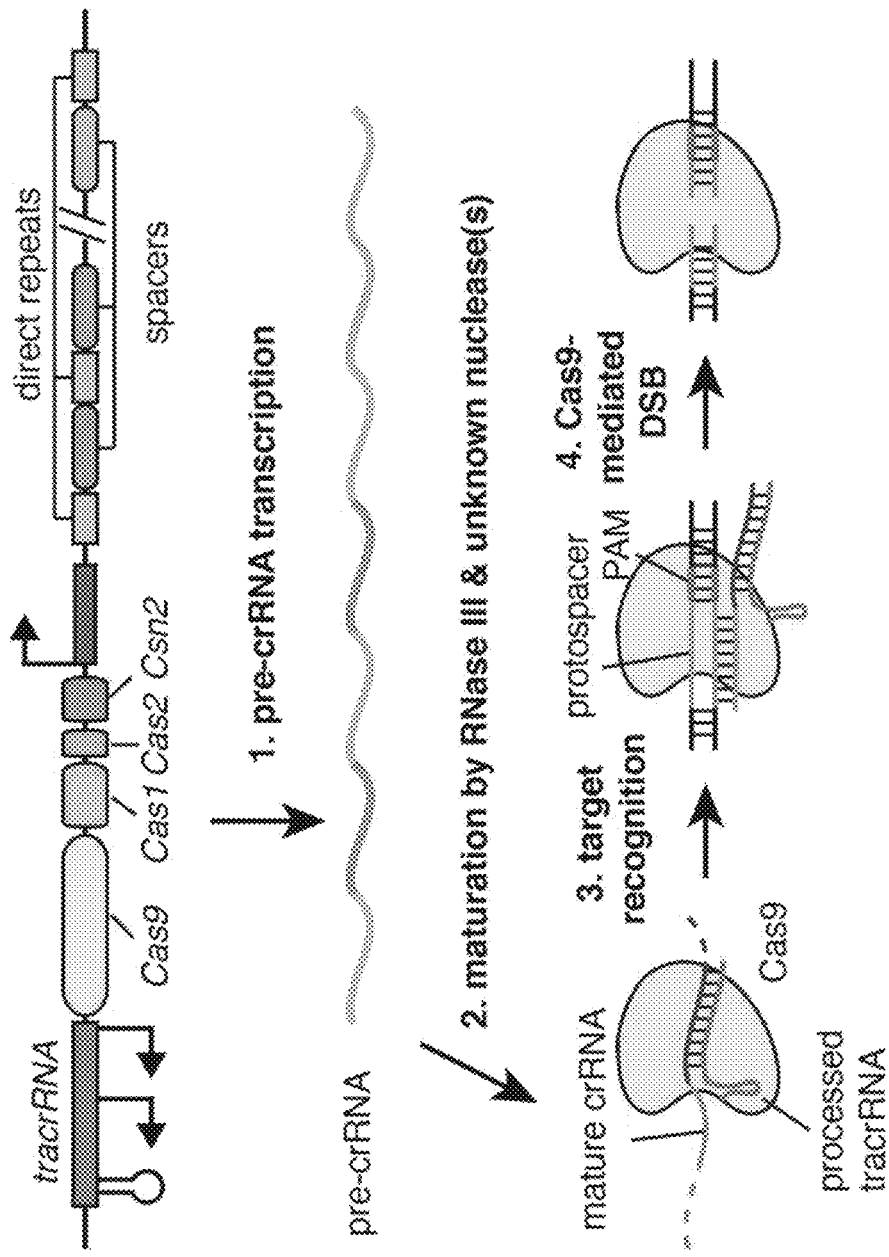
Figure 2B:
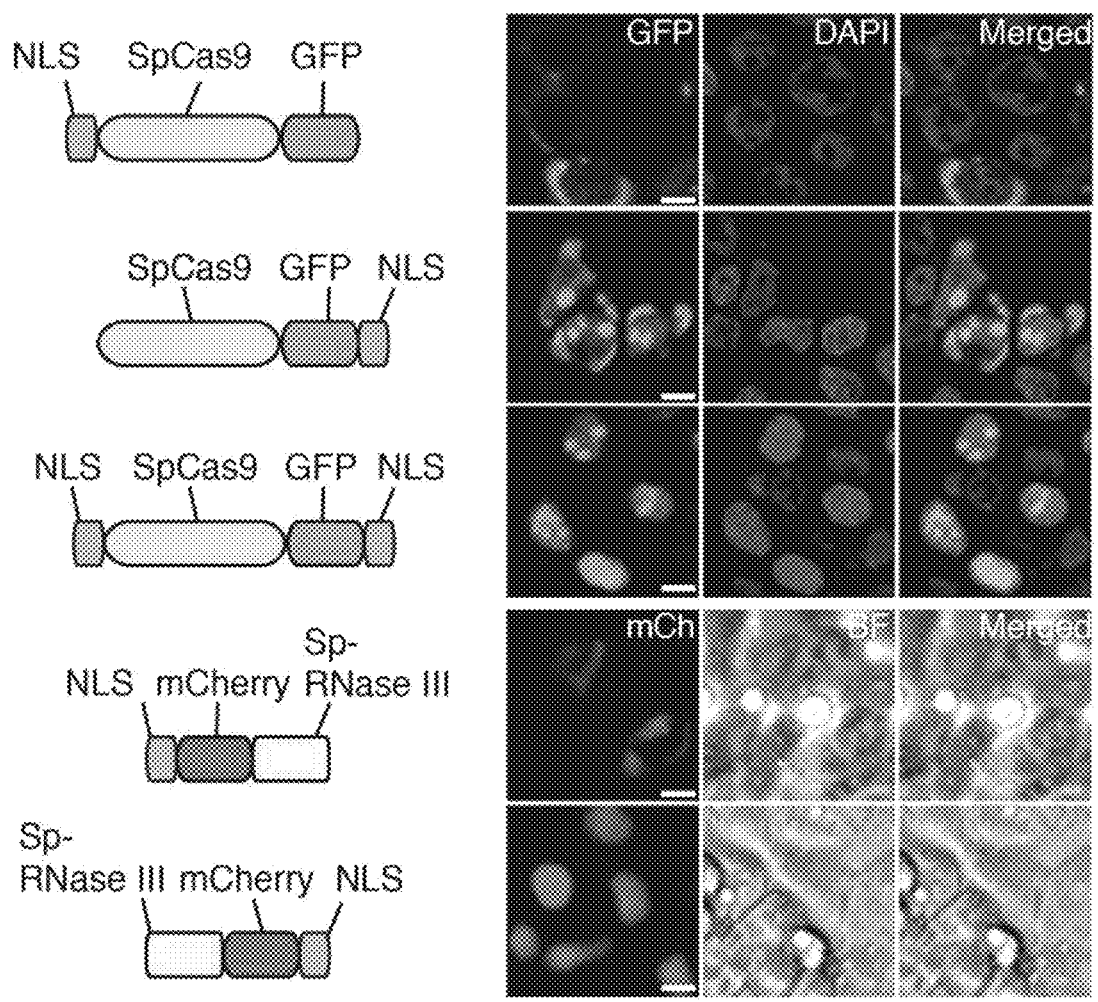

An example type II CRISPR system is the type II CRISPR locus from Streptococcus pyogenes SF370, which contains a cluster of four genes Cas9, Cas1, Cas2, and Csn1, as well as two non-coding RNA elements, tracrRNA and a characteristic array of repetitive sequences (direct repeats) interspaced by short stretches of non-repetitive sequences (spacers, about 30 bp each). In this system, targeted DNA double-strand break (DSB) is generated in four sequential steps (FIG. 2A). First, two non-coding RNAs, the pre-crRNA array and tracrRNA, are transcribed from the CRISPR locus. Second, tracrRNA hybridizes to the direct repeats of pre-crRNA, which is then processed into mature crRNAs containing individual spacer sequences. Third, the mature crRNA:tracrRNA complex directs Cas9 to the DNA target consisting of the protospacer and the corresponding PAM via heteroduplex formation between the spacer region of the crRNA and the protospacer DNA. Finally, Cas9 mediates cleavage of target DNA upstream of PAM to create a DSB within the protospacer (FIG. 2A). This example describes an example process for adapting this RNA-programmable nuclease system to direct CRISPR complex activity in the nuclei of eukaryotic cells.

Cell Culture and Transfection

Human embryonic kidney (HEK) cell line HEK 293FT (Life Technologies) was maintained in Dulbecco's modified Eagle's Medium (DMEM) supplemented with 10% fetal bovine serum (HyClone), 2 mM GlutaMAX (Life Technologies), 100 U/mL penicillin, and 100 µg/mL streptomycin at 37° C. with 5% $CO_2$ incubation. Mouse neuro2A (N2A) cell line (ATCC) was maintained with DMEM supplemented with 5% fetal bovine serum (HyClone), 2 mM GlutaMAX (Life Technologies), 100 U/mL penicillin, and 100 µg/mL streptomycin at 37° C. with 5% $CO_2$.

HEK 293FT or N2A cells were seeded into 24-well plates (Corning) one day prior to transfection at a density of 200,000 cells per well. Cells were transfected using Lipofectamine 2000 (Life Technologies) following the manufacturer's recommended protocol. For each well of a 24-well plate a total of 800 ng of plasmids were used.

Surveyor Assay and Sequencing Analysis for Genome Modification

HEK 293FT or N2A cells were transfected with plasmid DNA as described above. After transfection, the cells were incubated at 37° C. for 72 hours before genomic DNA extraction. Genomic DNA was extracted using the QuickExtract DNA extraction kit (Epicentre) following the manufacturer's protocol. Briefly, cells were resuspended in QuickExtract solution and incubated at 65° C. for 15 minutes and 98° C. for 10 minutes. Extracted genomic DNA was immediately processed or stored at −20° C.

Figure 7:
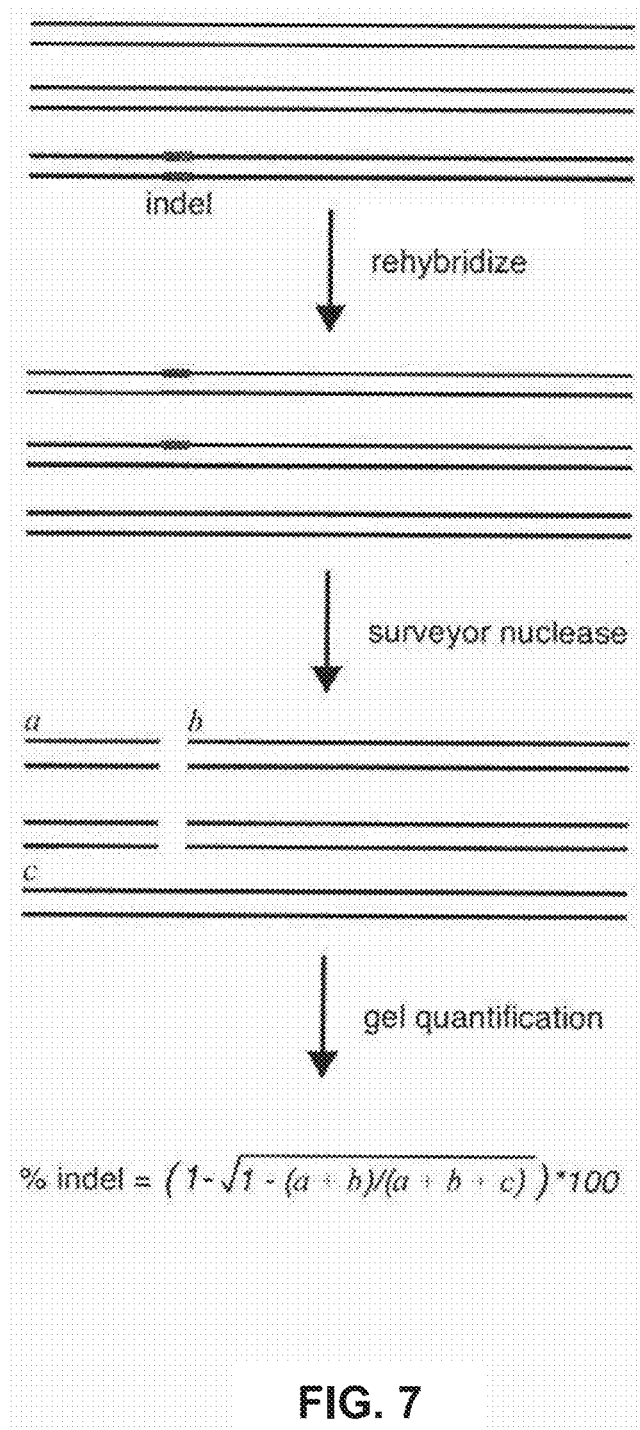
FIG. 7 shows a schematic of a surveyor nuclease assay for detection of double strand break-induced micro-insertions and -deletions.

The genomic region surrounding a CRISPR target site for each gene was PCR amplified, and products were purified using QiaQuick Spin Column (Qiagen) following manufacturer's protocol. A total of 400 ng of the purified PCR products were mixed with 2 µl 10×Taq polymerase PCR buffer (Enzymatics) and ultrapure water to a final volume of 20 µl, and subjected to a re-annealing process to enable heteroduplex formation: 95° C. for 10 min, 95° C. to 85° C. ramping at −2° C./s, 85° C. to 25° C. at −0.25° C./s, and 25° C. hold for 1 minute. After re-annealing, products were treated with Surveyor nuclease and Surveyor enhancer S (Transgenomics) following the manufacturer's recommended protocol, and analyzed on 4-20% Novex TBE poly-acrylamide gels (Life Technologies). Gels were stained with SYBR Gold DNA stain (Life Technologies) for 30 minutes and imaged with a Gel Doc gel imaging system (Bio-rad). Quantification was based on relative band intensities, as a measure of the fraction of cleaved DNA. FIG. 7 provides a schematic illustration of this Surveyor assay.

Restriction fragment length polymorphism assay for detection of homologous recombination.

HEK 293FT and N2A cells were transfected with plasmid DNA, and incubated at 37° C. for 72 hours before genomic DNA extraction as described above. The target genomic region was PCR amplified using primers outside the homology arms of the homologous recombination (HR) template. PCR products were separated on a 1% agarose gel and extracted with MinElute GelExtraction Kit (Qiagen). Purified products were digested with HindIII (Fermentas) and analyzed on a 6% Novex TBE poly-acrylamide gel (Life Technologies).

RNA Secondary Structure Prediction and Analysis

RNA secondary structure prediction was performed using the online webserver RNAfold developed at Institute for Theoretical Chemistry at the University of Vienna, using the centroid structure prediction algorithm (see e.g. A. R. Gruber et al., 2008, Cell 106(1): 23-24; and PA Carr and GM Church, 2009, Nature Biotechnology 27(12): 1151-62).

RNA Purification

HEK 293FT cells were maintained and transfected as stated above. Cells were harvested by trypsinization followed by washing in phosphate buffered saline (PBS). Total cell RNA was extracted with TRI reagent (Sigma) following manufacturer's protocol. Extracted total RNA was quantified using Nanodrop (Thermo Scientific) and normalized to same concentration.

Northern Blot Analysis of crRNA and tracrRNA Expression in Mammalian Cells

RNAs were mixed with equal volumes of 2× loading buffer (Ambion), heated to 95° C. for 5 min, chilled on ice for 1 min, and then loaded onto 8% denaturing polyacrylamide gels (SequaGel, National Diagnostics) after pre-running the gel for at least 30 minutes. The samples were electrophoresed for 1.5 hours at 40 W limit. Afterwards, the RNA was transferred to Hybond N+ membrane (GE Healthcare) at 300 mA in a semi-dry transfer apparatus (Bio-rad) at room temperature for 1.5 hours. The RNA was crosslinked to the membrane using autocrosslink button on Stratagene UV Crosslinker the Stratalinker (Stratagene). The membrane was pre-hybridized in ULTRAhyb-Oligo Hybridization Buffer (Ambion) for 30 min with rotation at 42° C., and probes were then added and hybridized overnight. Probes were ordered from IDT and labeled with [gamma-$^{32}$P] ATP (Perkin Elmer) with T4 polynucleotide kinase (New England Biolabs). The membrane was washed once with pre-warmed (42° C.) 2×SSC, 0.5% SDS for 1 min followed by two 30 minute washes at 42° C. The membrane was exposed to a phosphor screen for one hour or overnight at room temperature and then scanned with a phosphorimager (Typhoon).

Bacterial CRISPR System Construction and Evaluation

Figure 6A:
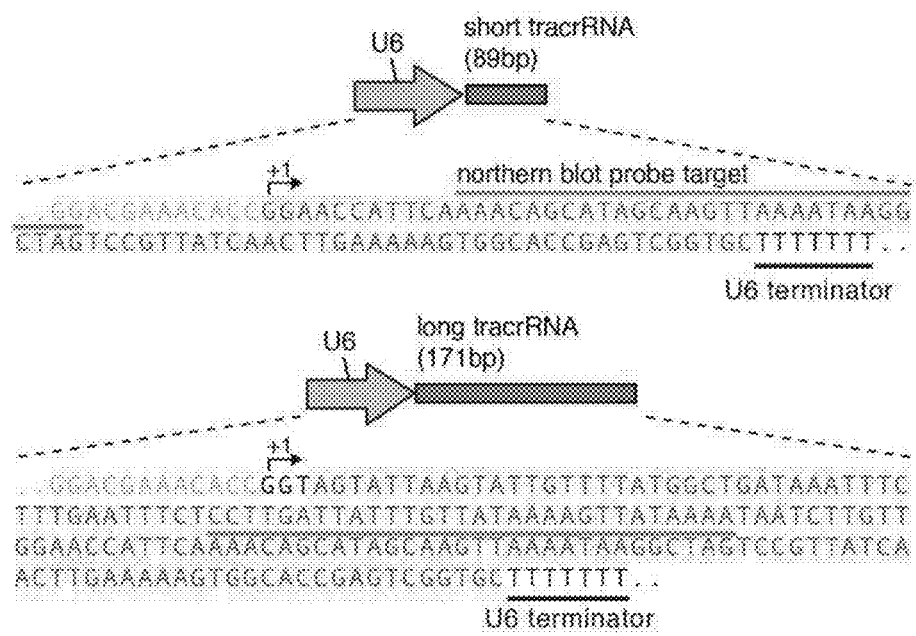
FIG. 6A-C shows a comparison of different tracrRNA transcripts for Cas9-mediated gene targeting.
Figure 6B:
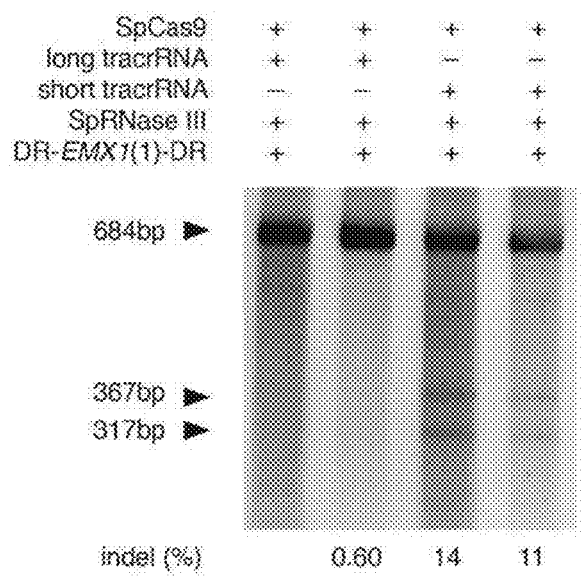
Figure 6C:
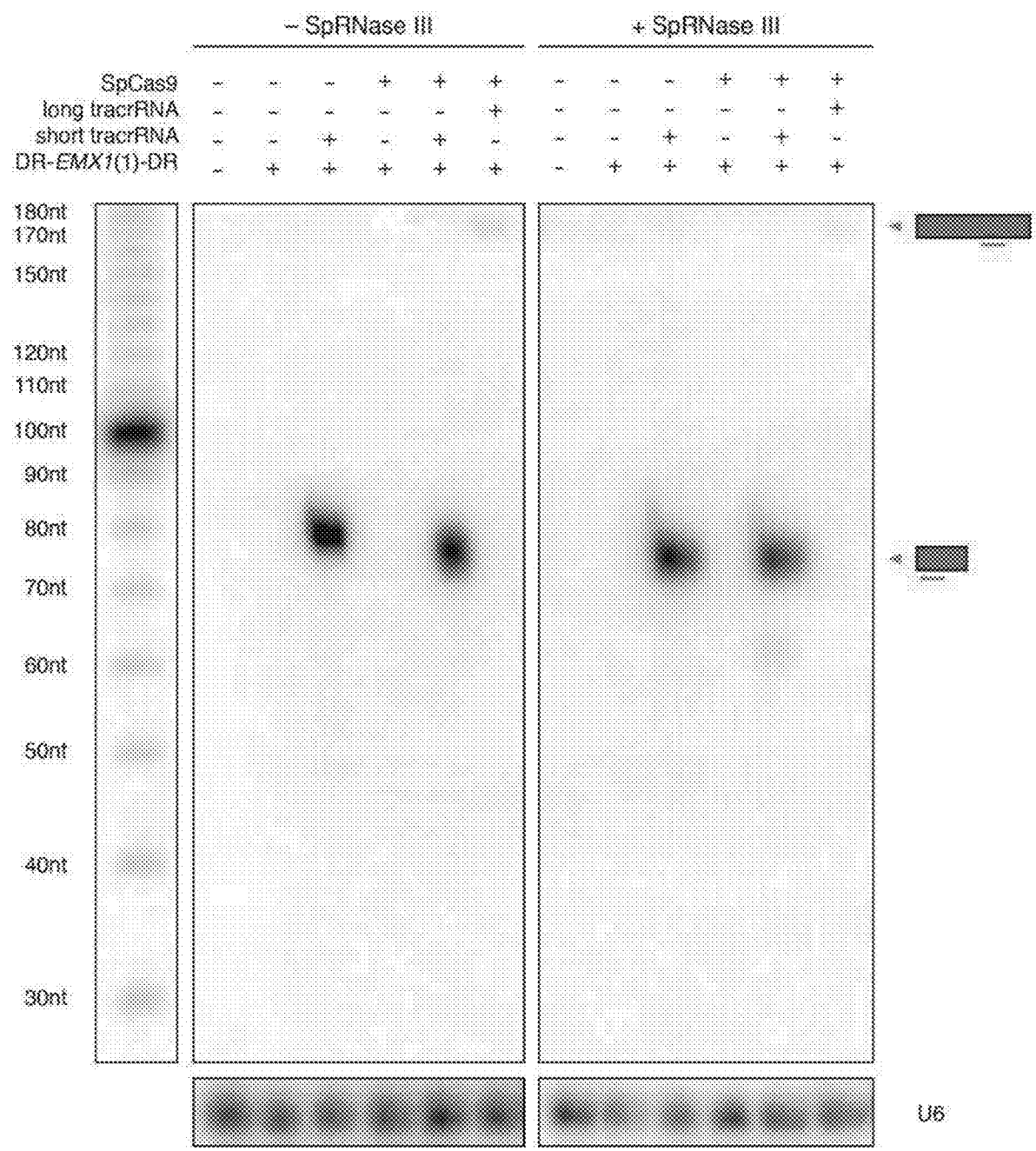

CRISPR locus elements, including tracrRNA, Cas9, and leader were PCR amplified from *Streptococcus pyogenes* SF370 genomic DNA with flanking homology arms for Gibson Assembly. Two BsaI type IIS sites were introduced in between two direct repeats to facilitate easy insertion of spacers (FIG. 8). PCR products were cloned into EcoRV-digested pACYC184 downstream of the tet promoter using Gibson Assembly Master Mix (NEB). Other endogenous CRISPR system elements were omitted, with the exception of the last 50 bp of Csn2. Oligos (Integrated DNA Technology) encoding spacers with complimentary overhangs were cloned into the BsaI-digested vector pDC000 (NEB) and then ligated with T7 ligase (Enzymatics) to generate pCRISPR plasmids. Challenge plasmids containing spacers with PAM expression in mammalian cells (expression constructs illustrated in FIG. 6A, with functionality as determined by results of the Surveyor assay shown in FIG. 6B). Transcription start sites are marked as +1, and transcription terminator and the sequence probed by northern blot are also indicated. Expression of processed tracrRNA was also confirmed by Northern blot. FIG. 6C shows results of a Northern blot analysis of total RNA extracted from 293FT cells transfected with U6 expression constructs carrying long or short tracrRNA, as well as SpCas9 and DR-EMX1(1)-DR. Left and right panels are from 293FT cells transfected without or with SpRNase III, respectively. U6 indicate loading control blotted with a probe targeting human U6 snRNA. Transfection of the short tracrRNA expression construct led to abundant levels of the processed form of tracrRNA (~75 bp). Very low amounts of long tracrRNA are detected on the Northern blot.

Figure 2C:
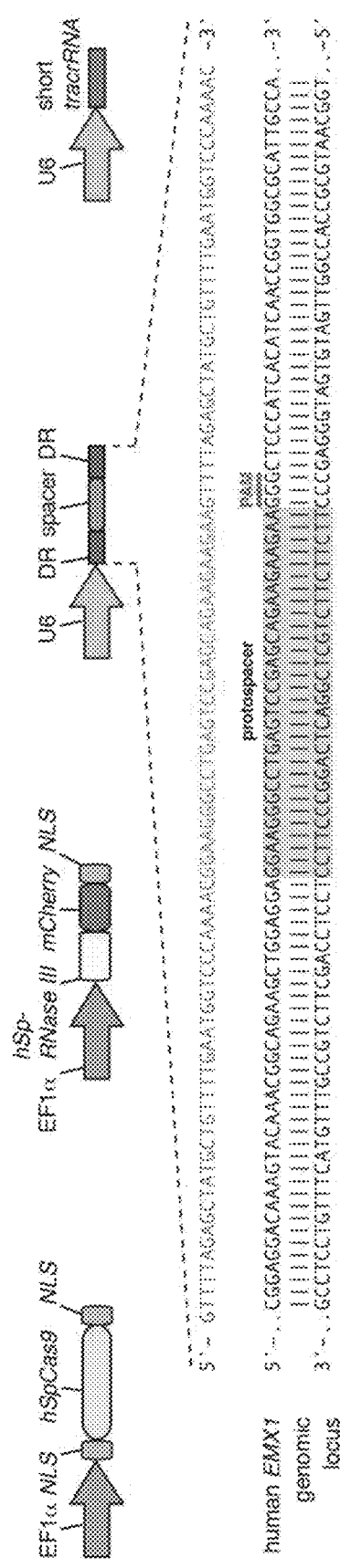

To promote precise transcriptional initiation, the RNA polymerase III-based U6 promoter was selected to drive the expression of tracrRNA (FIG. 2C). Similarly, a U6 promoter-based construct was developed to express a precrRNA array consisting of a single spacer flanked by two direct repeats (DRs, also encompassed by the term "tracr-mate sequences"; FIG. 2C). The initial spacer was designed to target a 33-base-pair (bp) target site (30-bp protospacer plus a 3-bp CRISPR motif (PAM) sequence satisfying the NGG recognition motif of Cas9) in the human EMX1 locus (FIG. 2C), a key gene in the development of the cerebral cortex.

Figure 2D:
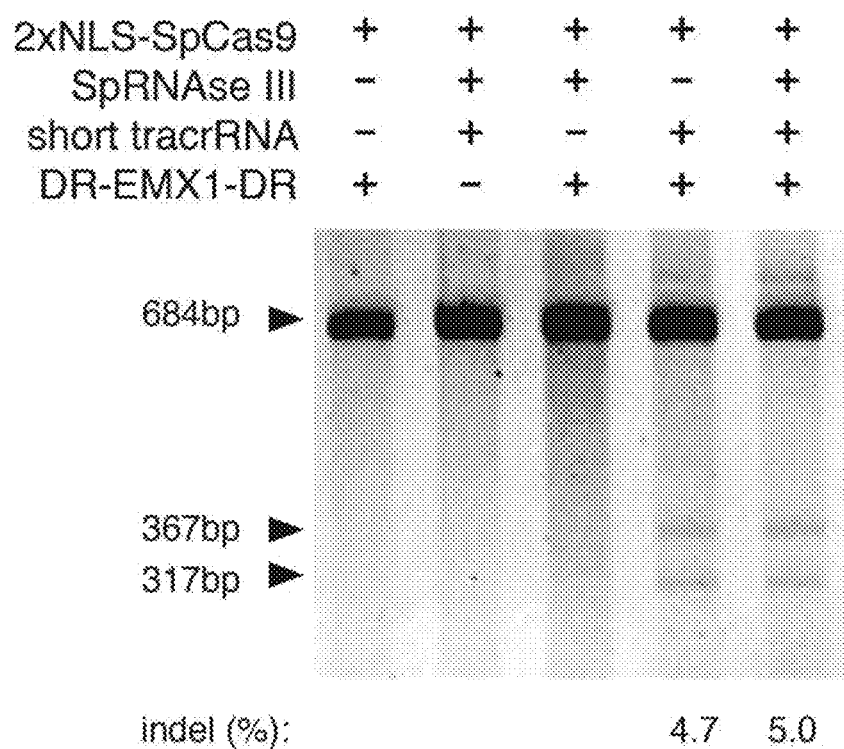

To test whether heterologous expression of the CRISPR system (SpCas9, SpRNase III, tracrRNA, and pre-crRNA) in mammalian cells can achieve targeted cleavage of mammalian chromosomes, HEK 293FT cells were transfected with combinations of CRISPR components. Since DSBs in mammalian nuclei are partially repaired by the non-homologous end joining (NHEJ) pathway, which leads to the formation of indels, the Surveyor assay was used to detect potential cleavage activity at the target EMX1 locus (FIG. 7) (see e.g. Guschin et al., 2010, Methods Mol Biol 649: 247). Co-transfection of all four CRISPR components was able to induce up to 5.0% cleavage in the protospacer (see FIG. 2D). Co-transfection of all CRISPR components minus SpRNase III also induced up to 4.7% indel in the protospacer, suggesting that there may be endogenous mammalian RNases that are capable of assisting with crRNA maturation, such as for example the related Dicer and Drosha enzymes. Removing any of the remaining three components abolished the genome cleavage activity of the CRISPR system (FIG. 2D). Sanger sequencing of amplicons containing the target locus verified the cleavage activity: in 43 sequenced clones, 5 mutated alleles (11.6%) were found. Similar experiments using a variety of guide sequences produced indel percentages as high as 29% (see FIGS. 3-6, 10, and 11). These results define a three-component system for efficient CRISPR-mediated genome modification in mammalian cells. To optimize the cleavage efficiency, Applicants also tested whether different isoforms of tracrRNA affected the cleavage efficiency and found that, in this example system, only the short (89-bp) transcript form was able to mediate cleavage of the human EMX1 genomic locus (FIG. 6B).

Figure 12A:
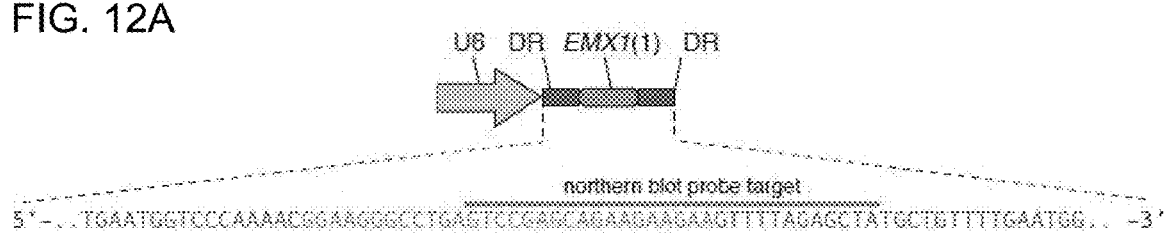
FIG. 12A-B shows the results of a Northern blot analysis of crRNA processing in mammalian cells.
Figure 12B:
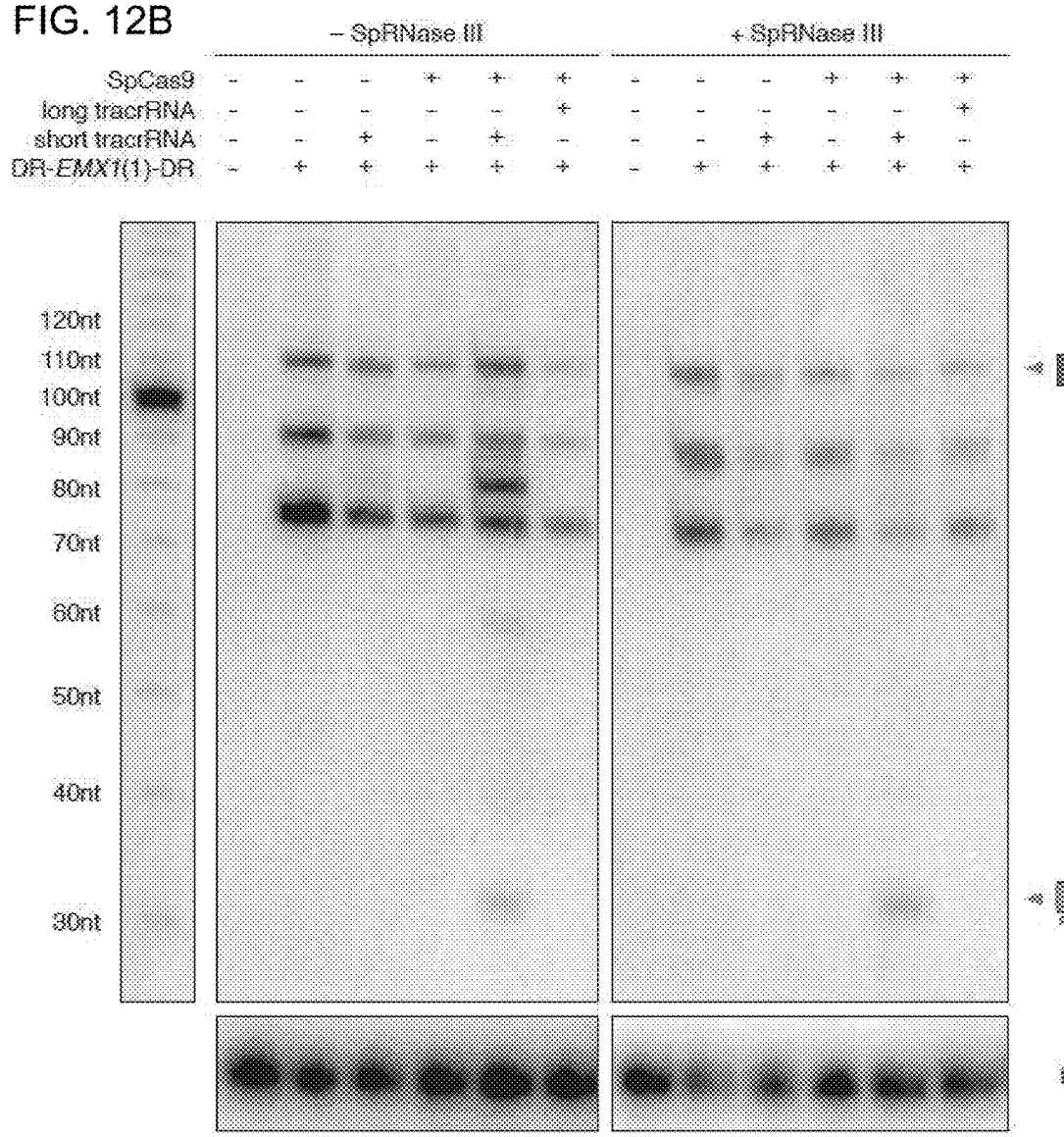

FIG. 12 provides an additional Northern blot analysis of crRNA processing in mammalian cells. FIG. 12A illustrates a schematic showing the expression vector for a single spacer flanked by two direct repeats (DR-EMX1(1)-DR). The 30 bp spacer targeting the human EMX1 locus protospacer 1 (see FIG. 6) and the direct repeat sequences are shown in the sequence beneath FIG. 12A. The line indicates the region whose reverse-complement sequence was used to generate Northern blot probes for EMX1(1) crRNA detection. FIG. 12B shows a Northern blot analysis of total RNA extracted from 293FT cells transfected with U6 expression constructs carrying DR-EMX1(1)-DR. Left and right panels are from 293FT cells transfected without or with SpRNase III respectively. DR-EMX1(1)-DR was processed into mature crRNAs only in the presence of SpCas9 and short tracrRNA and was not dependent on the presence of SpRNase III. The mature crRNA detected from transfected 293FT total RNA is ~33 bp and is shorter than the 39-42 bp mature crRNA from *S. pyogenes*. These results demonstrate that a CRISPR system can be transplanted into eukaryotic cells and reprogrammed to facilitate cleavage of endogenous mammalian target polynucleotides.

FIG. 2 illustrates the bacterial CRISPR system described in this example. FIG. 2A illustrates a schematic showing the CRISPR locus 1 from *Streptococcus pyogenes* SF370 and a proposed mechanism of CRISPR-mediated DNA cleavage by this system. Mature crRNA processed from the direct repeat-spacer array directs Cas9 to genomic targets consisting of complimentary protospacers and a protospacer-adjacent motif (PAM). Upon target-spacer base pairing, Cas9 mediates a double-strand break in the target DNA. FIG. 2B illustrates engineering of *S. pyogenes* Cas9 (SpCas9) and RNase III (SpRNase III) with nuclear localization signals (NLSs) to enable import into the mammalian nucleus. FIG. 2C illustrates mammalian expression of SpCas9 and SpRNase III driven by the constitutive EF1a promoter and tracrRNA and pre-crRNA array (DR-Spacer-DR) driven by the RNA Pol3 promoter U6 to promote precise transcription initiation and termination. A protospacer from the human EMX1 locus with a satisfactory PAM sequence is used as the spacer in the pre-crRNA array. FIG. 2D illustrates surveyor nuclease assay for SpCas9-mediated minor insertions and deletions. SpCas9 was expressed with and without SpRNase III, tracrRNA, and a pre-crRNA array carrying the EMX1-target spacer. FIG. 2E illustrates a schematic representation of base pairing between target locus and EMX1-targeting crRNA, as well as an example chromatogram showing a micro deletion adjacent to the SpCas9 cleavage site. FIG. 2F illustrates mutated alleles identified from sequencing analysis of 43 clonal amplicons showing a variety of micro insertions and deletions. Dashes indicate deleted bases, and non-aligned or mismatched bases indicate insertions or mutations. Scale bar=10 μm.

To further simplify the three-component system, a chimeric crRNA-tracrRNA hybrid design was adapted, where a mature crRNA (comprising a guide sequence) may be fused to a partial tracrRNA via a stem-loop to mimic the natural crRNA:tracrRNA duplex. To increase co-delivery efficiency, a bicistronic expression vector was created to drive co-expression of a chimeric RNA and SpCas9 in transfected cells. In parallel, the bicistronic vectors were used to express a pre-crRNA (DR-guide sequence-DR) with SpCas9, to induce processing into crRNA with a separately expressed tracrRNA (compare FIG. 11B top and bottom). FIG. 8 provides schematic illustrations of bicistronic expression vectors for pre-crRNA array (FIG. 8A) or chimeric crRNA (represented by the short line downstream of the guide sequence insertion site and upstream of the EF1α promoter in FIG. 8B) with hSpCas9, showing location of various elements and the point of guide sequence insertion. The expanded sequence around the location of the guide sequence insertion site in FIG. 8B also shows a partial DR sequence (GTTTTAGAGCTA) (SEQ ID NO: 39) and a partial tracrRNA sequence (TAGCAAGT-TAAAATAAGGCTAGTCCGTTTTT) (SEQ ID NO: 40). Guide sequences can be inserted between BbsI sites using annealed oligonucleotides. Sequence design for the oligonucleotides are shown below the schematic illustrations in FIG. 8, with appropriate ligation adapters indicated. WPRE represents the Woodchuck hepatitis virus post-transcriptional regulatory element. The efficiency of chimeric RNA-mediated cleavage was tested by targeting the same EMX1 locus described above. Using both Surveyor assay and Sanger sequencing of amplicons, Applicants confirmed that the chimeric RNA design facilitates cleavage of human EMX1 locus with approximately a 4.7% modification rate (FIG. 3).

Figure 13A:
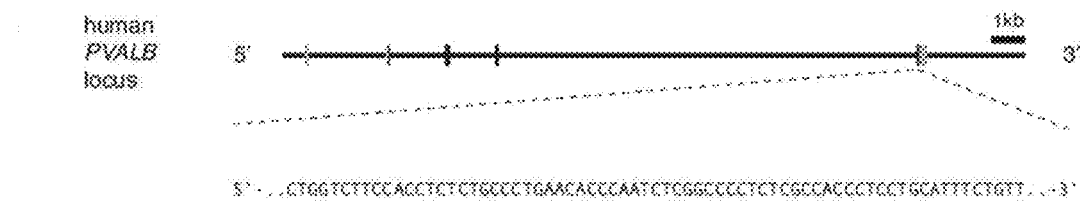
FIG. 13A-B shows an exemplary selection of protospacers in the human PVALB (SEQ ID NO: 280) and mouse Th loci (SEQ ID NO: 281).
Figure 13B:
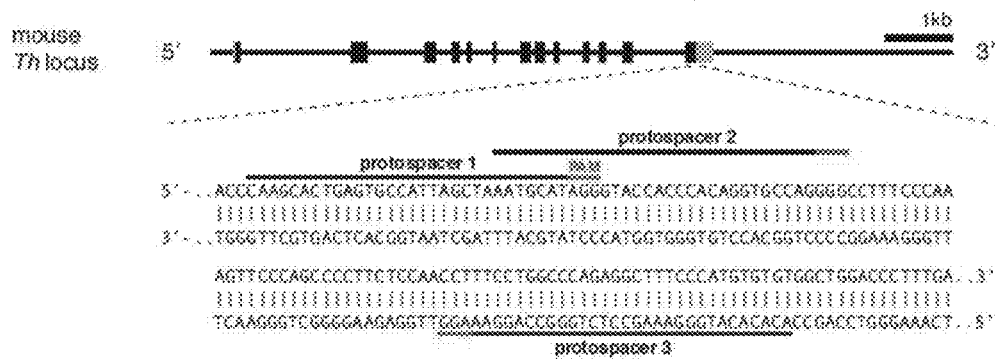

Generalizability of CRISPR-mediated cleavage in eukaryotic cells was tested by targeting additional genomic loci in both human and mouse cells by designing chimeric RNA targeting multiple sites in the human EMX1 and PVALB, as well as the mouse Th loci. FIG. 13 illustrates the selection of some additional targeted protospacers in human PVALB (FIG. 13A) and mouse Th (FIG. 13B) loci. Schematics of the gene loci and the location of three protospacers within the last exon of each are provided. The underlined sequences include 30 bp of protospacer sequence and 3 bp at the 3' end corresponding to the PAM sequences. Protospacers on the sense and anti-sense strands are indicated above and below the DNA sequences, respectively. A modification rate of 6.3% and 0.75% was achieved for the human PVALB and mouse Th loci respectively, demonstrating the broad applicability of the CRISPR system in modifying different loci across multiple organisms (FIG. 5). While cleavage was only detected with one out of three spacers for each locus using the chimeric constructs, all target sequences were cleaved with efficiency of indel production reaching 27% when using the co-expressed pre-crRNA arrangement (FIGS. 6 and 13).

FIG. 11 provides a further illustration that SpCas9 can be reprogrammed to target multiple genomic loci in mammalian cells. FIG. 11A provides a schematic of the human EMX1 locus showing the location of five protospacers, indicated by the underlined sequences. FIG. 11B provides a schematic of the pre-crRNA/trcrRNA complex showing hybridization between the direct repeat region of the pre-crRNA and tracrRNA (top), and a schematic of a chimeric RNA design comprising a 20 bp guide sequence, and tracr mate and tracr sequences consisting of partial direct repeat and tracrRNA sequences hybridized in a hairpin structure (bottom). Results of a Surveyor assay comparing the efficacy of Cas9-mediated cleavage at five protospacers in the human EMX1 locus is illustrated in FIG. 11C. Each protospacer is targeted using either processed pre-crRNA/tracrRNA complex (crRNA) or chimeric RNA (chiRNA).

Since the secondary structure of RNA can be crucial for intermolecular interactions, a structure prediction algorithm based on minimum free energy and Boltzmann-weighted structure ensemble was used to compare the putative secondary structure of all guide sequences used in the genome targeting experiment (see e.g. Gruber et al., 2008, Nucleic Acids Research, 36: W70). Analysis revealed that in most cases, the effective guide sequences in the chimeric crRNA context were substantially free of secondary structure motifs, whereas the ineffective guide sequences were more likely to form internal secondary structures that could prevent base pairing with the target protospacer DNA. It is thus possible that variability in the spacer secondary structure might impact the efficiency of CRISPR-mediated interference when using a chimeric crRNA.

Figure 22B:
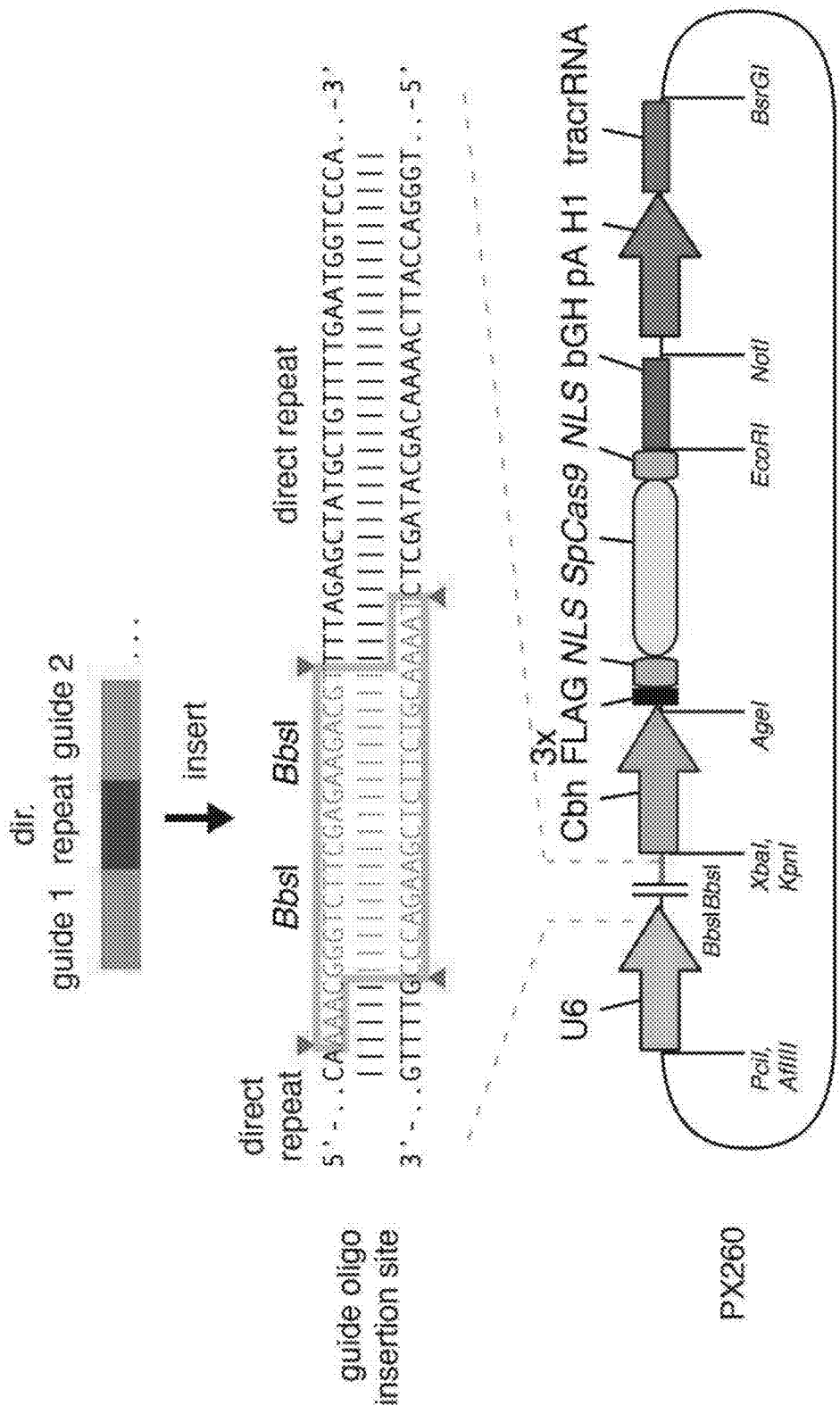

Further vector designs for SpCas9 are shown in FIG. 22, which illustrates single expression vectors incorporating a U6 promoter linked to an insertion site for a guide oligo, and a Cbh promoter linked to SpCas9 coding sequence. The vector shown in FIG. 22b includes a tracrRNA coding sequence linked to an H1 promoter.

Figure 3A:
FIG. 3A-D shows results of an evaluation of SpCas9 specificity for an example target.
Figure 3B:
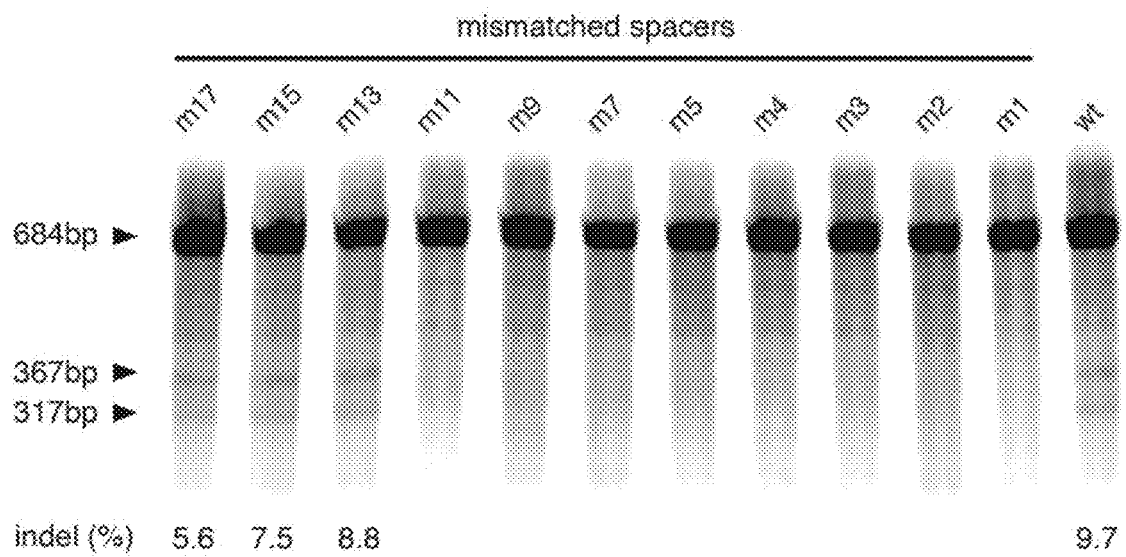
Figure 3C:

In the bacterial assay, all spacers facilitated efficient CRISPR interference (FIG. 3C). These results suggest that there may be additional factors affecting the efficiency of CRISPR activity in mammalian cells.

Figure 3D:
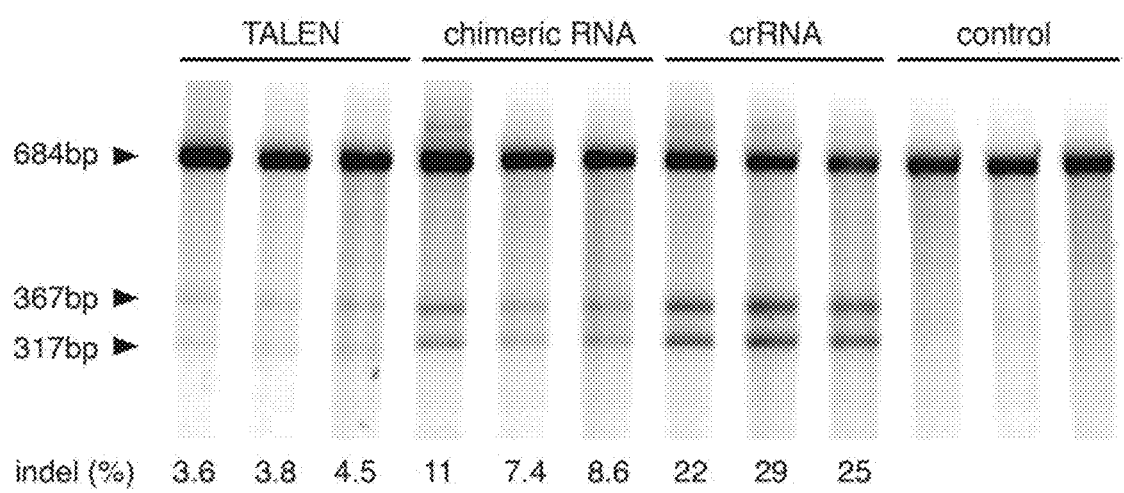

To investigate the specificity of CRISPR-mediated cleavage, the effect of single-nucleotide mutations in the guide sequence on protospacer cleavage in the mammalian genome was analyzed using a series of EMX1-targeting chimeric crRNAs with single point mutations (FIG. 3A). FIG. 3B illustrates results of a Surveyor nuclease assay comparing the cleavage efficiency of Cas9 when paired with different mutant chimeric RNAs. Single-base mismatch up to 12-bp 5' of the PAM substantially abrogated genomic cleavage by SpCas9, whereas spacers with mutations at farther upstream positions retained activity against the original protospacer target (FIG. 3B). In addition to the PAM, SpCas9 has single-base specificity within the last 12-bp of the spacer. Furthermore, CRISPR is able to mediate genomic cleavage as efficiently as a pair of TALE nucleases (TALEN) targeting the same EMX1 protospacer. FIG. 3C provides a schematic showing the design of TALENs targeting EMX1, and FIG. 3D shows a Surveyor gel comparing the efficiency of TALEN and Cas9 (n=3).

Figure 4C:
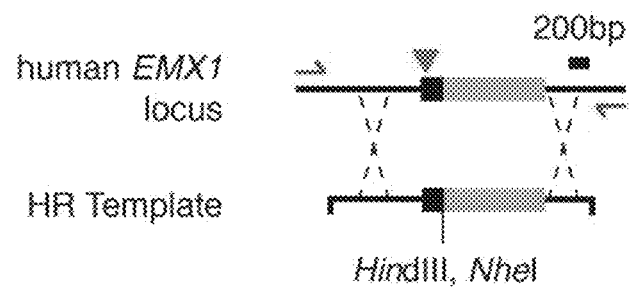
Figure 4D:
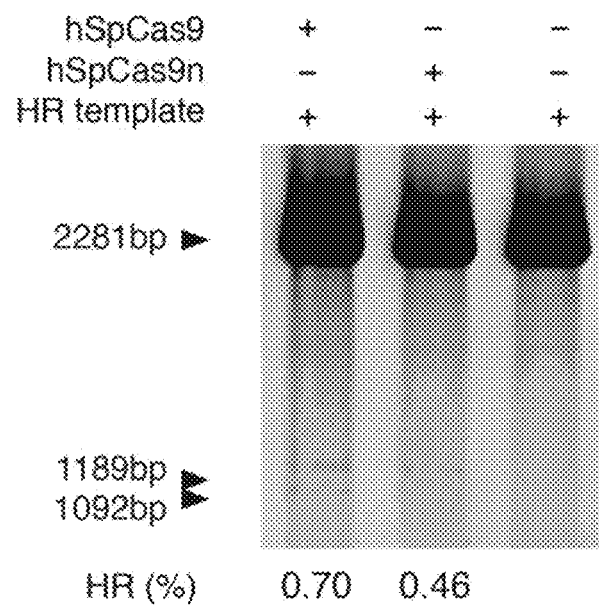
Figure 4E:
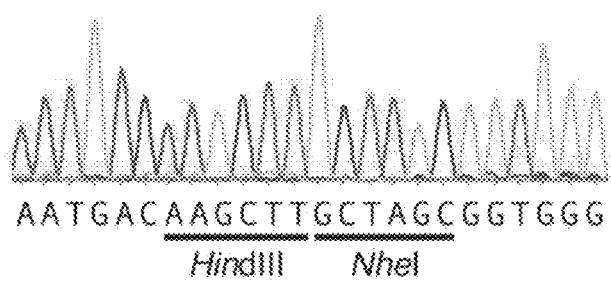

Having established a set of components for achieving CRISPR-mediated gene editing in mammalian cells through the error-prone NHEJ mechanism, the ability of CRISPR to stimulate homologous recombination (HR), a high fidelity gene repair pathway for making precise edits in the genome, was tested. The wild type SpCas9 is able to mediate site-specific DSBs, which can be repaired through both NHEJ and HR. In addition, an aspartate-to-alanine substitution (D10A) in the RuvC I catalytic domain of SpCas9 was engineered to convert the nuclease into a nickase (SpCas9n; illustrated in FIG. 4A) (see e.g. Sapranausaks et al., 2011, Nucleic Acids Research, 39: 9275; Gasiunas et al., 2012, Proc. Natl. Acad. Sci. USA, 109:E2579), such that nicked genomic DNA undergoes the high-fidelity homology-directed repair (HDR). Surveyor assay confirmed that SpCas9n does not generate indels at the EMX1 protospacer target. As illustrated in FIG. 4B, co-expression of EMX1-targeting chimeric crRNA with SpCas9 produced indels in the target site, whereas co-expression with SpCas9n did not (n=3). Moreover, sequencing of 327 amplicons did not detect any indels induced by SpCas9n. The same locus was selected to test CRISPR-mediated HR by co-transfecting HEK 293FT cells with the chimeric RNA targeting EMX1, hSpCas9 or hSpCas9n, as well as a HR template to introduce a pair of restriction sites (HindIII and NheI) near the protospacer. FIG. 4C provides a schematic illustration of the HR strategy, with relative locations of recombination points and primer annealing sequences (arrows). SpCas9 and SpCas9n indeed catalyzed integration of the HR template into the EMX1 locus. PCR amplification of the target region followed by restriction digest with HindIII revealed cleavage products corresponding to expected fragment sizes (arrows in restriction fragment length polymorphism gel analysis shown in FIG. 4D), with SpCas9 and SpCas9n mediating similar levels of HR efficiencies. Applicants further verified HR using Sanger sequencing of genomic amplicons (FIG. 4E). These results demonstrate the utility of CRISPR for facilitating targeted gene insertion in the mammalian genome. Given the 14-bp (12-bp from the spacer and 2-bp from the PAM) target specificity of the wild type SpCas9, the availability of a nickase can significantly reduce the likelihood of off-target modifications, since single strand breaks are not substrates for the error-prone NHEJ pathway.

Figure 4F:
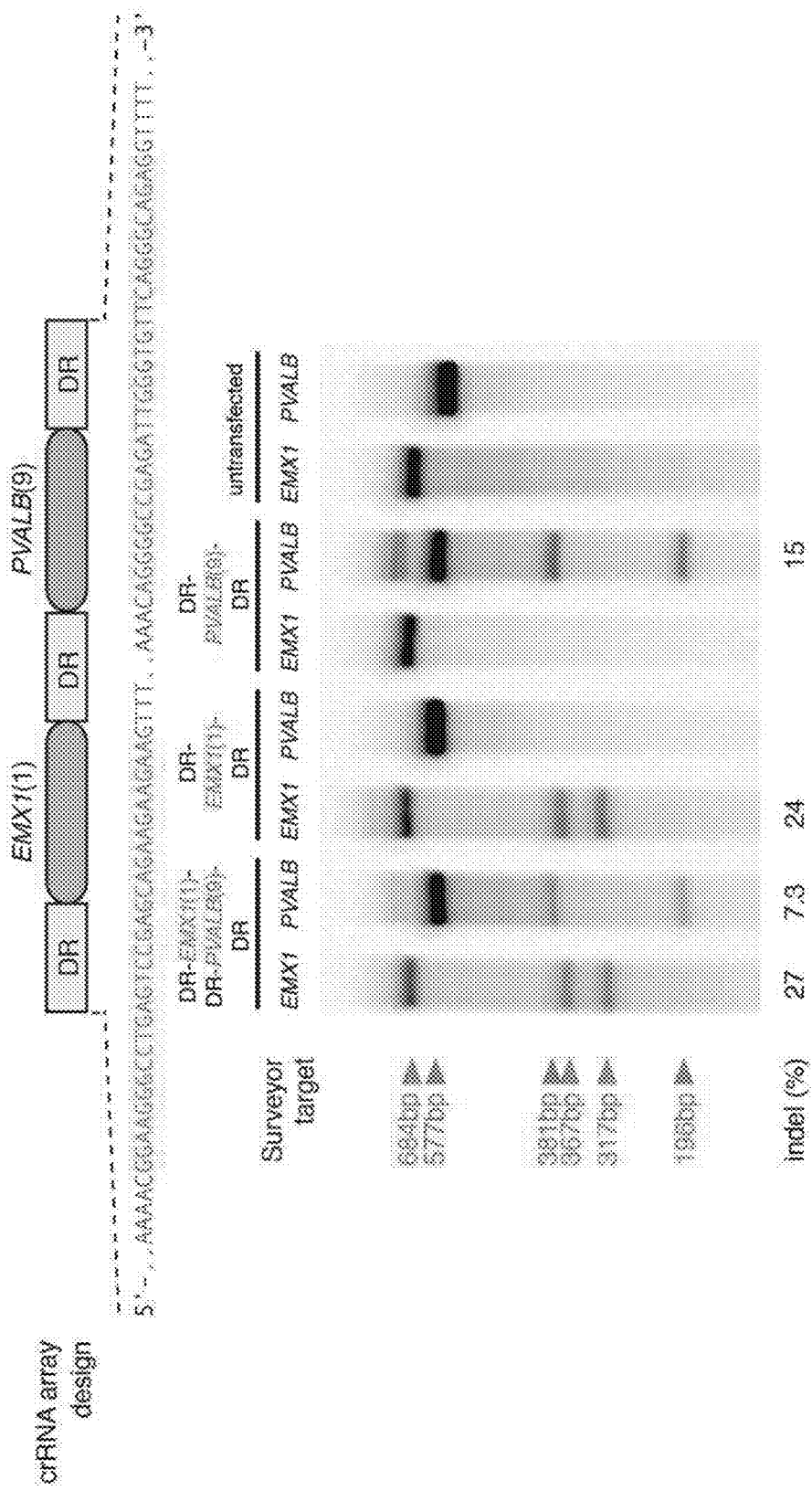
Figure 4G:
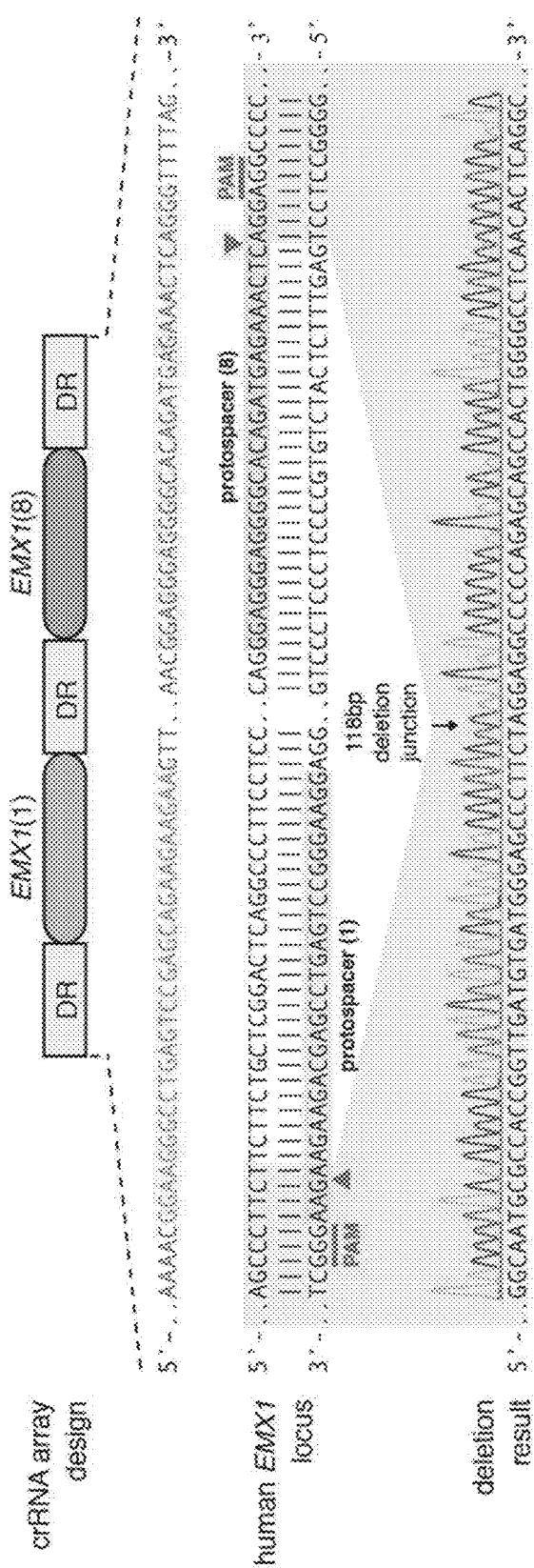

Expression constructs mimicking the natural architecture of CRISPR loci with arrayed spacers (FIG. 2A) were constructed to test the possibility of multiplexed sequence targeting. Using a single CRISPR array encoding a pair of EMX1- and PVALB-targeting spacers, efficient cleavage at both loci was detected (FIG. 4F, showing both a schematic design of the crRNA array and a Surveyor blot showing efficient mediation of cleavage). Targeted deletion of larger genomic regions through concurrent DSBs using spacers against two targets within EMX1 spaced by 119 bp was also tested, and a 1.6% deletion efficacy (3 out of 182 amplicons; FIG. 4G) was detected. This demonstrates that the CRISPR system can mediate multiplexed editing within a single genome.

Example 2: CRISPR System Modifications and Alternatives

Figure 10A:
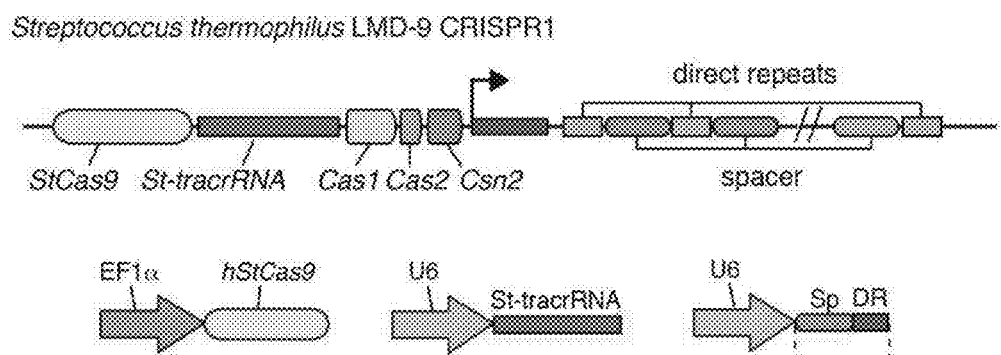
FIG. 10A-D shows an exemplary CRISPR system, an example adaptation for expression in eukaryotic cells, and results of tests assessing CRISPR activity.
Figure 10B:
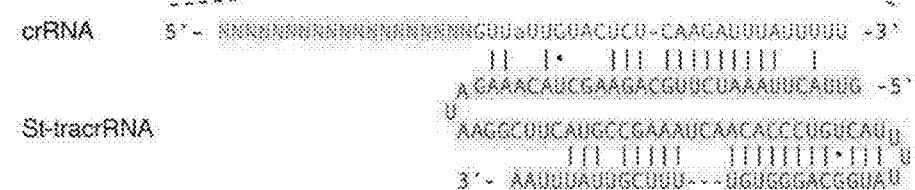
Figure 10C:
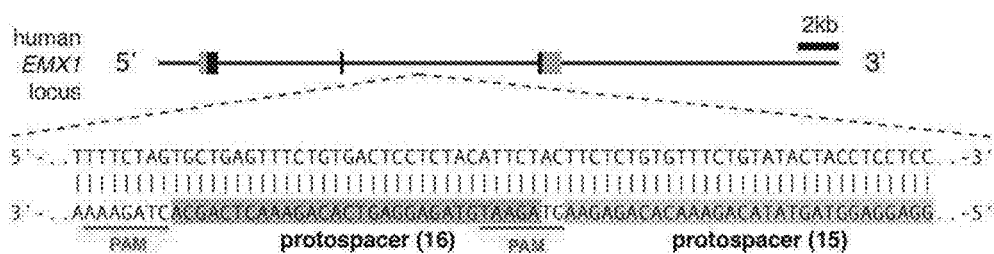
Figure 10D:
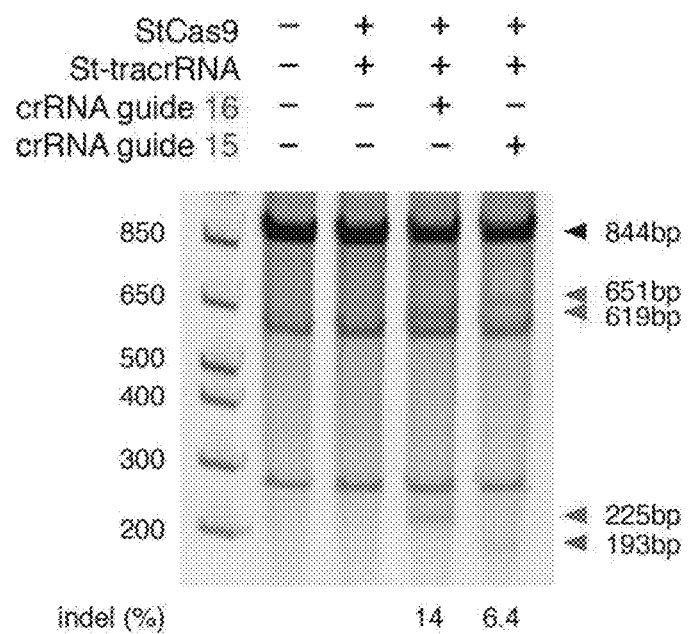
Figure 14:
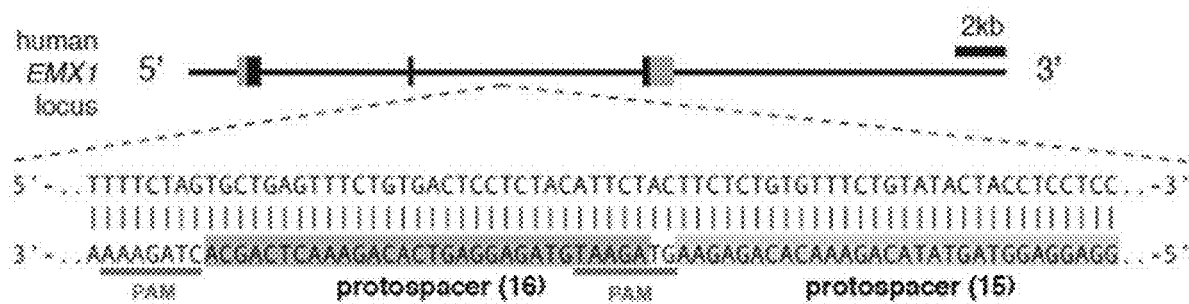
FIG. 14 shows example protospacer and corresponding PAM sequence targets of the S. thermophilus CRISPR system in the human EMX1 locus.

The ability to use RNA to program sequence-specific DNA cleavage defines a new class of genome engineering tools for a variety of research and industrial applications. Several aspects of the CRISPR system can be further improved to increase the efficiency and versatility of CRISPR targeting. Optimal Cas9 activity may depend on the availability of free $Mg^{2+}$ at levels higher than that present in the mammalian nucleus (see e.g. Jinek et al., 2012, Science, 337:816), and the preference for an NGG motif immediately downstream of the protospacer restricts the ability to target on average every 12-bp in the human genome (FIG. 9, evaluating both plus and minus strands of human chromosomal sequences). Some of these constraints can be overcome by exploring the diversity of CRISPR loci across the microbial metagenome (see e.g. Makarova et al., 2011, Nat Rev Microbiol, 9:467). Other CRISPR loci may be transplanted into the mammalian cellular milieu by a process similar to that described in Example 1. For example, FIG. 10 illustrates adaptation of the Type II CRISPR system from CRISPR 1 of *Streptococcus thermophilus* LMD-9 for heterologous expression in mammalian cells to achieve CRISPR-mediated genome editing. FIG. 10A provides a Schematic illustration of CRISPR 1 from *S. thermophilus* LMD-9. FIG. 10B illustrates the design of an expression system for the *S. thermophilus* CRISPR system. Human codon-optimized hStCas9 is expressed using a constitutive EF1α promoter. Mature versions of tracrRNA and crRNA are expressed using the U6 promoter to promote precise transcription initiation. Sequences from the mature crRNA and tracrRNA are illustrated. A single base indicated by the lower case "a" in the crRNA sequence is used to remove the polyU sequence, which serves as a RNA polIII transcriptional terminator. FIG. 10C provides a schematic showing guide sequences targeting the human EMX1 locus. FIG. 10D shows the results of hStCas9-mediated cleavage in the target locus using the Surveyor assay. RNA guide spacers 1 and 2 induced 14% and 6.4%, respectively. Statistical analysis of cleavage activity across biological replica at these two protospacer sites is also provided in FIG. 5. FIG. 14 provides a schematic of additional protospacer and corresponding PAM sequence targets of the *S. thermophilus* CRISPR system in the human EMX1 locus. Two protospacer sequences are highlighted and their corresponding PAM sequences satisfying NNAGAAW motif are indicated by underlining 3' with respect to the corresponding highlighted sequence. Both protospacers target the anti-sense strand.

Example 3: Sample Target Sequence Selection Algorithm

A software program is designed to identify candidate CRISPR target sequences on both strands of an input DNA sequence based on desired guide sequence length and a CRISPR motif sequence (PAM) for a specified CRISPR enzyme. For example, target sites for Cas9 from *S. pyogenes*, with PAM sequences NGG, may be identified by searching for 5'-$N_x$NGG-3' both on the input sequence and on the reverse-complement of the input. Likewise, target sites for Cas9 of *S. thermophilus* CRISPR1, with PAM sequence NNAGAAW, may be identified by searching for 5'-$N_x$NNAGAAW-3' both on the input sequence and on the reverse-complement of the input. Likewise, target sites for Cas9 of *S. thermophilus* CRISPR3, with PAM sequence NGGNG, may be identified by searching for 5'-$N_x$NGGNG-3' both on the input sequence and on the reverse-complement of the input. The value "x" in $N_x$ may be fixed by the program or specified by the user, such as 20.

Figure 18:
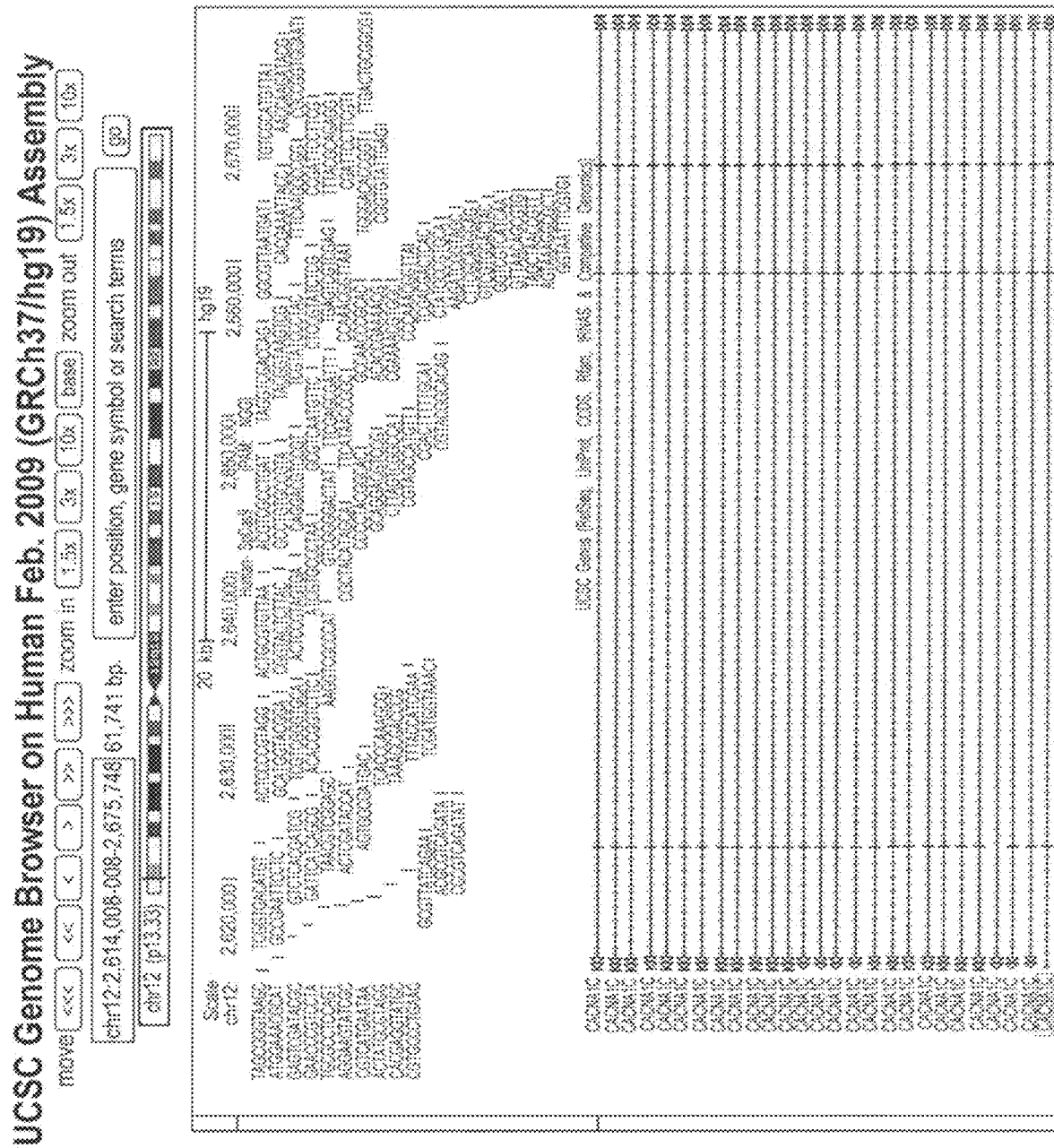
FIG. 18 shows an exemplary visualization of some S. pyogenes Cas9 target sites in the human genome using the UCSC genome browser.
Figure 19A:
FIG. 19A-D shows a circular depiction of the phylogenetic analysis revealing five families of Cas9s, including three groups of large Cas9s (~1400 amino acids) and two of small Cas9s (~1100 amino acids).
Figure 19B:
Figure 19C:
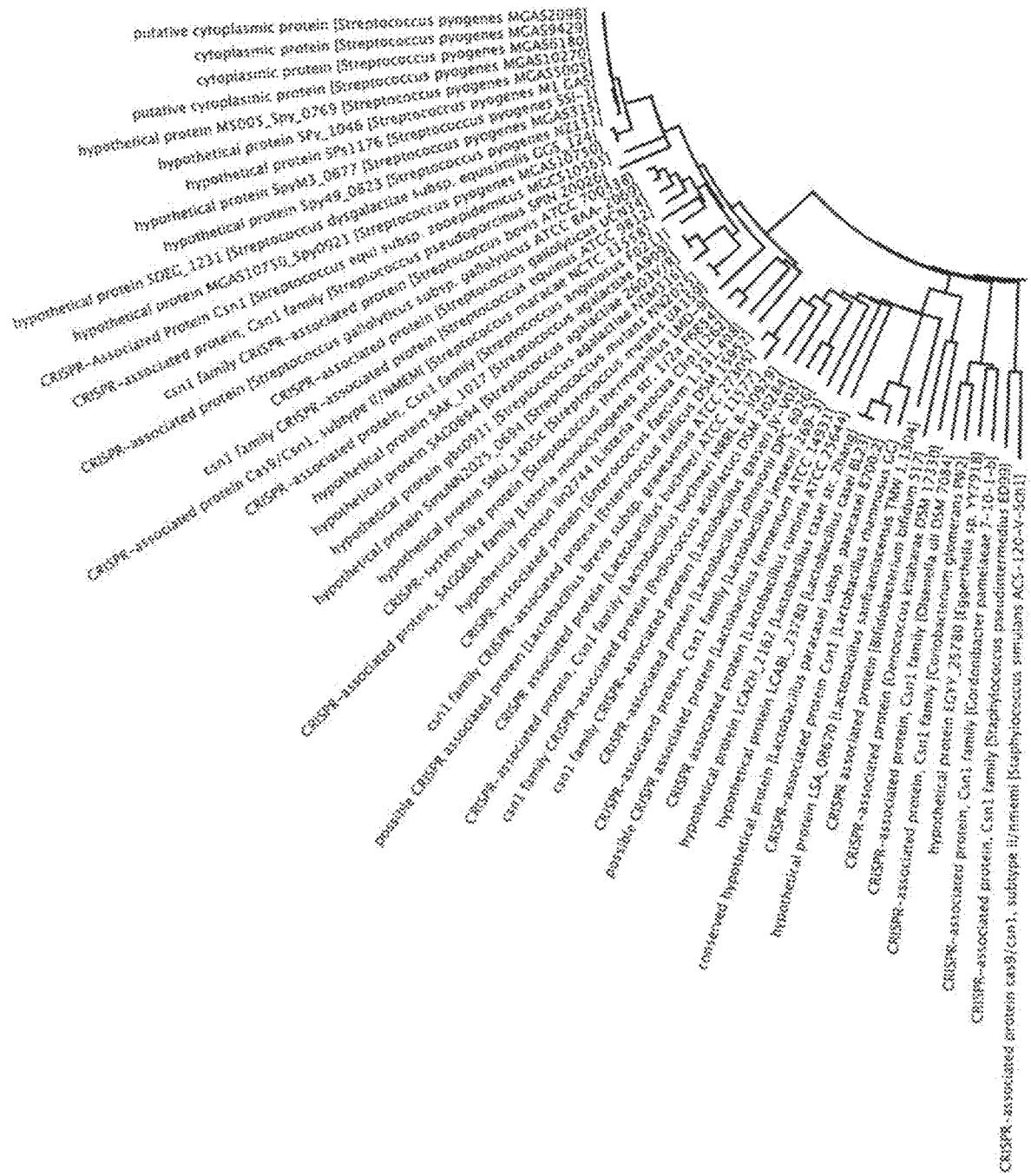
Figure 19D:
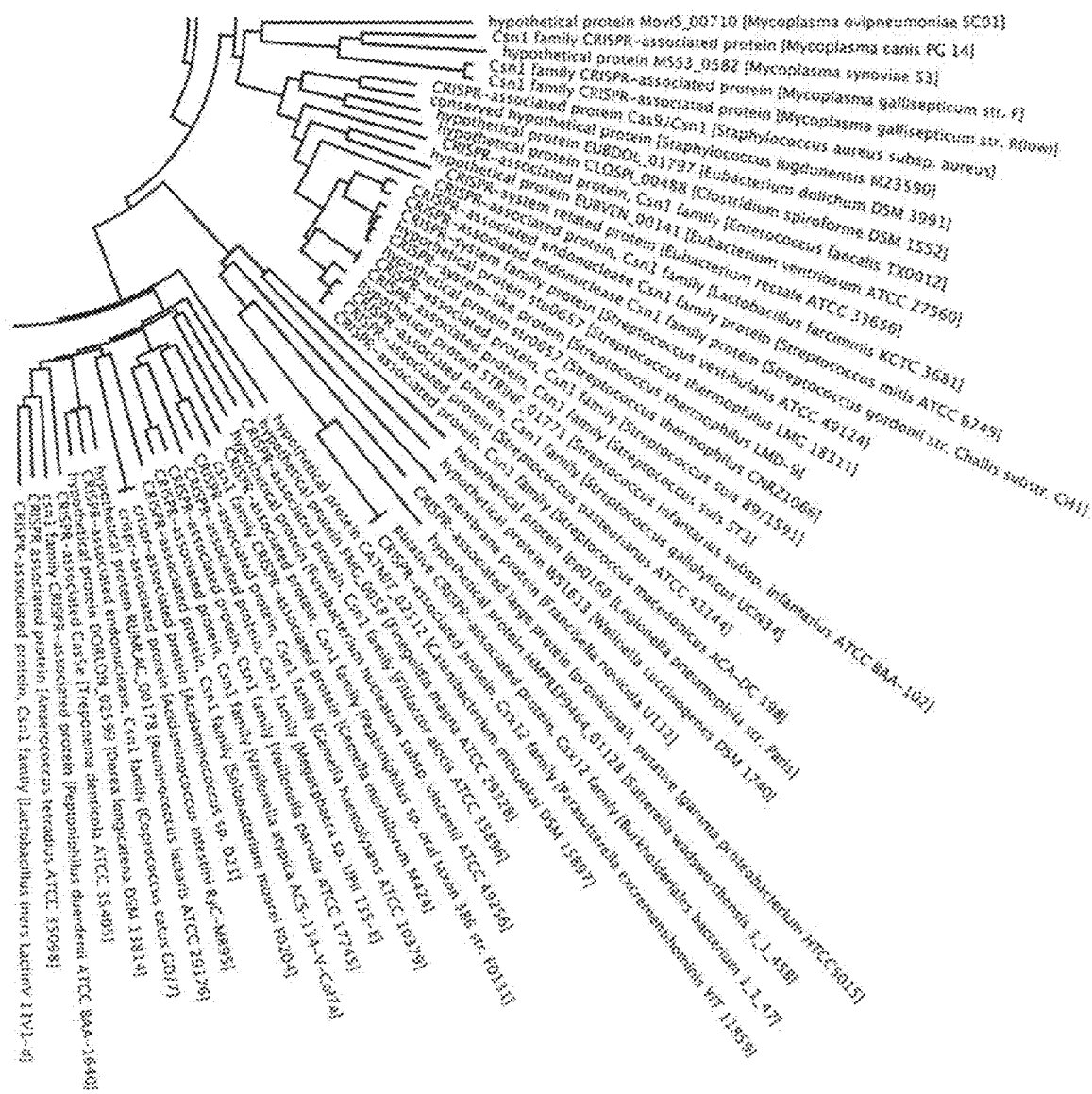
Figure 20A:
FIG. 20A-F shows the linear depiction of the phylogenetic analysis revealing five families of Cas9s, including three groups of large Cas9s (~1400 amino acids) and two of small Cas9s (~1100 amino acids).
Figure 20B:
Figure 20C:
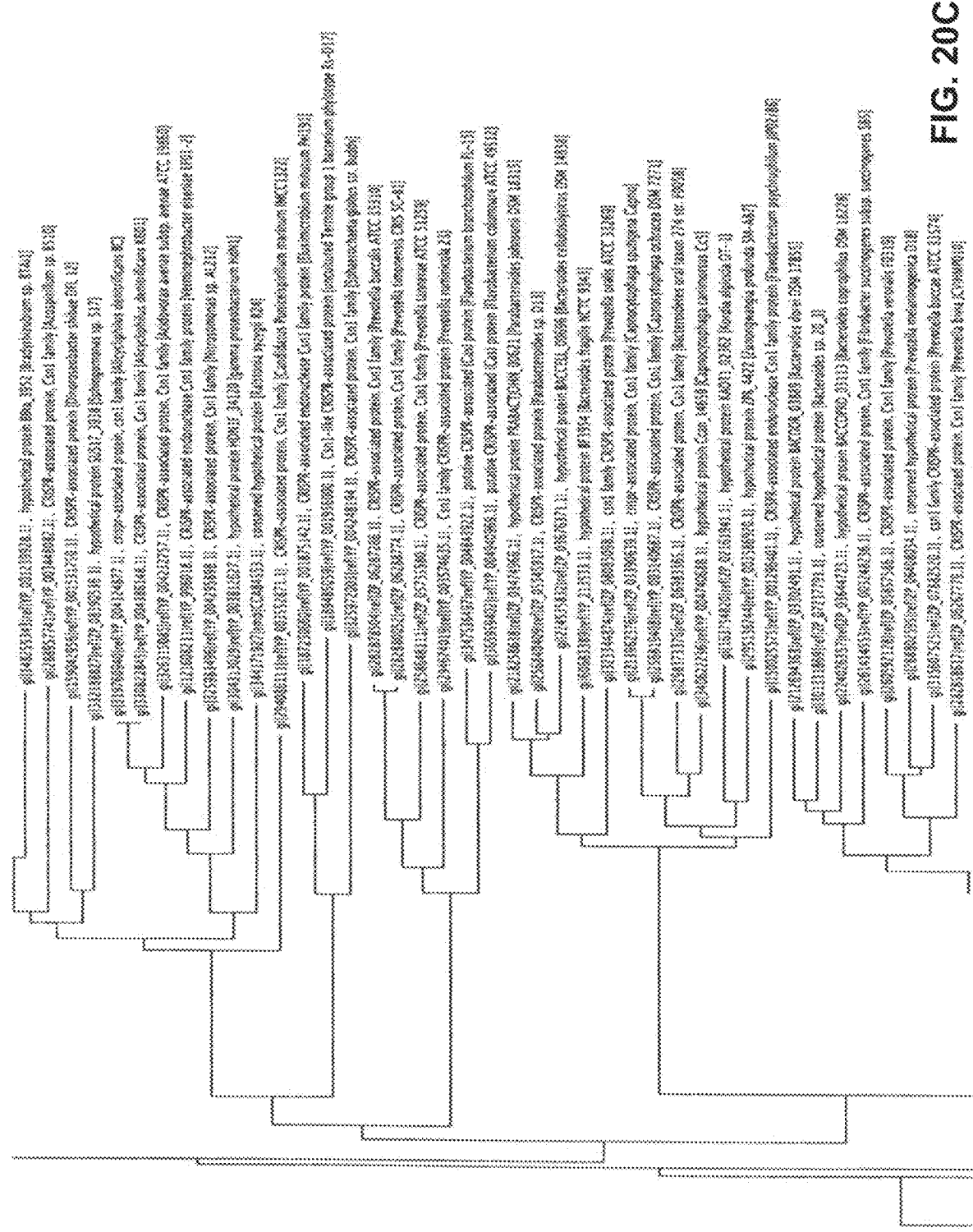
Figure 20D:
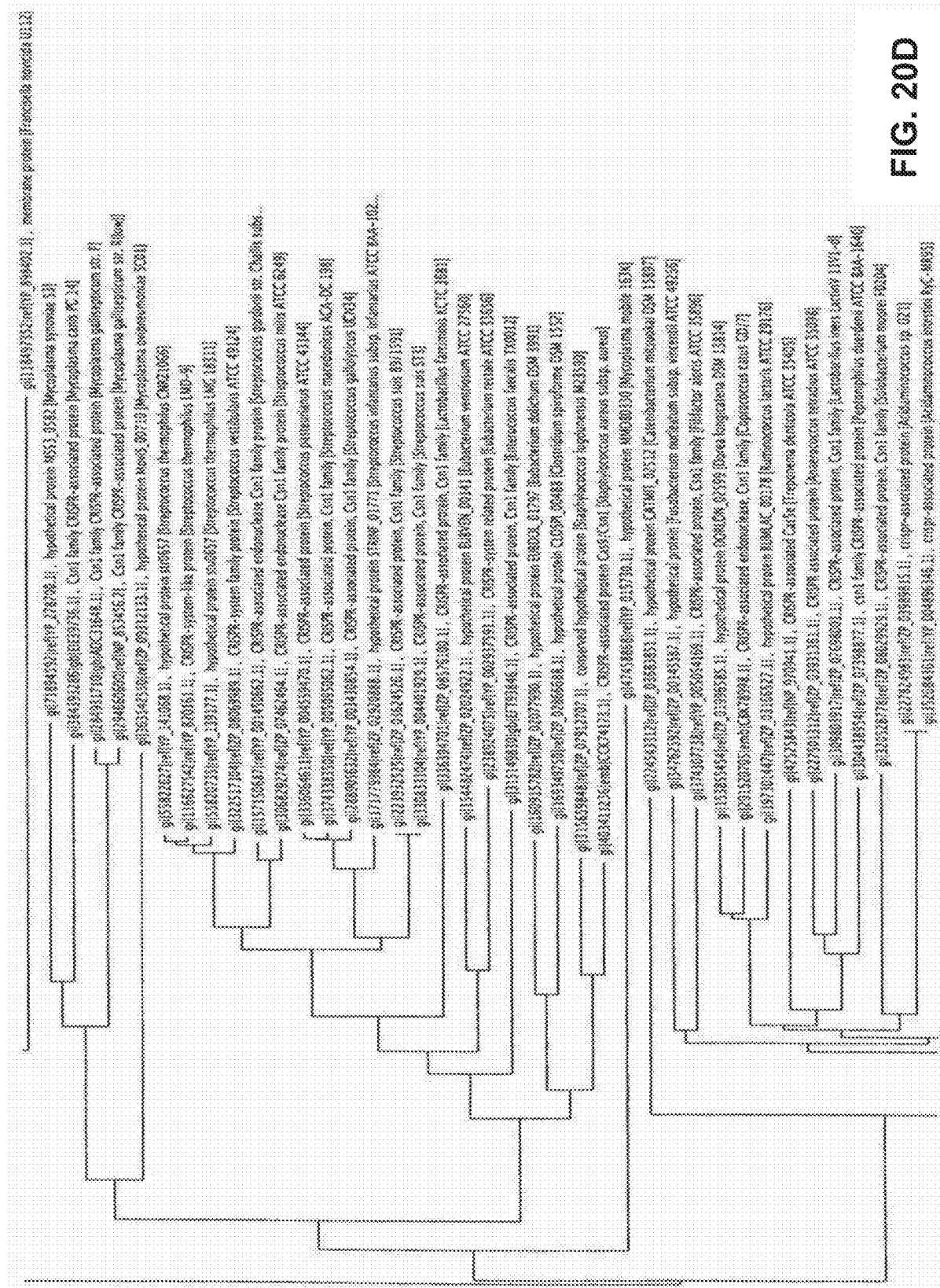
Figure 20E:
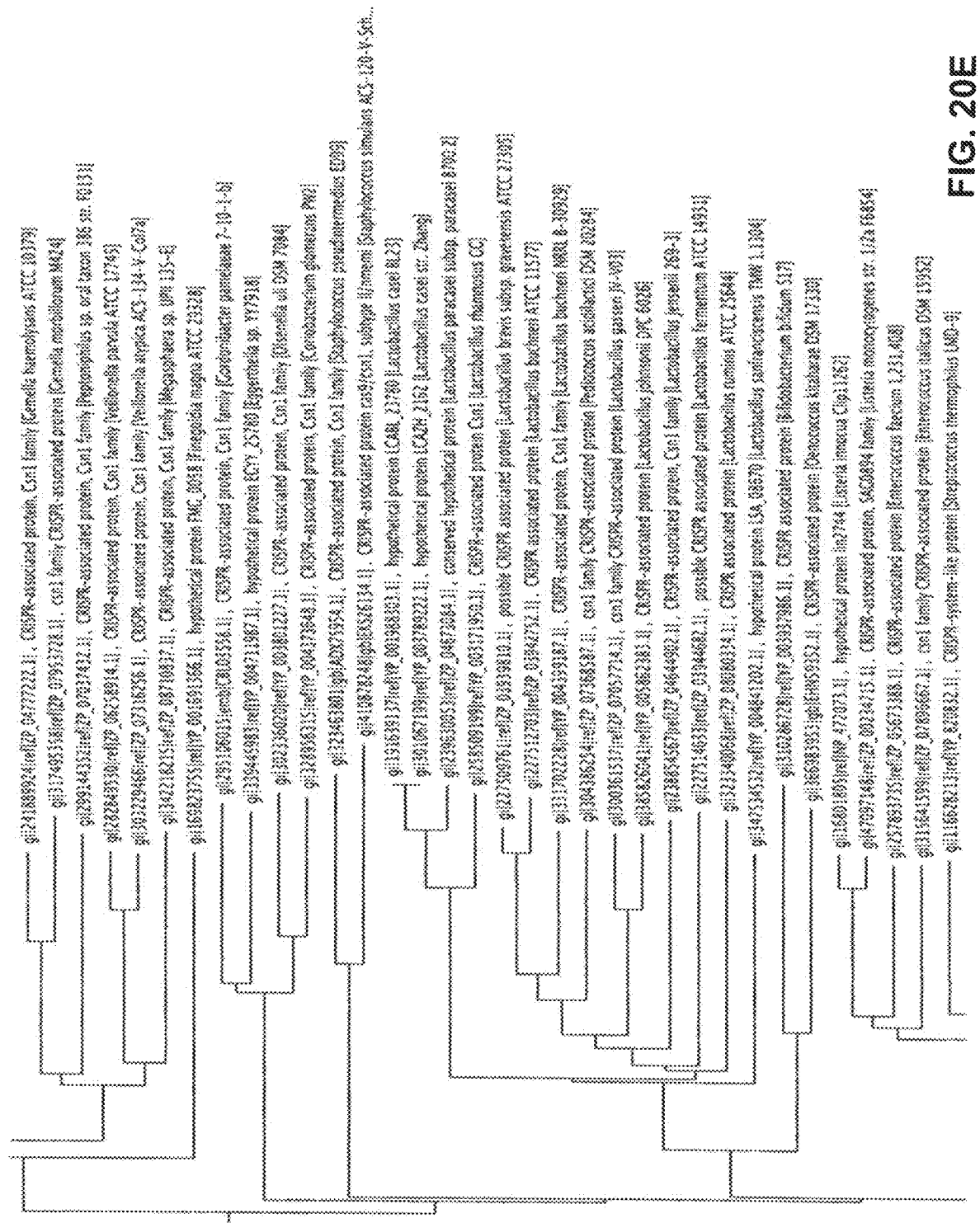
Figure 20F:
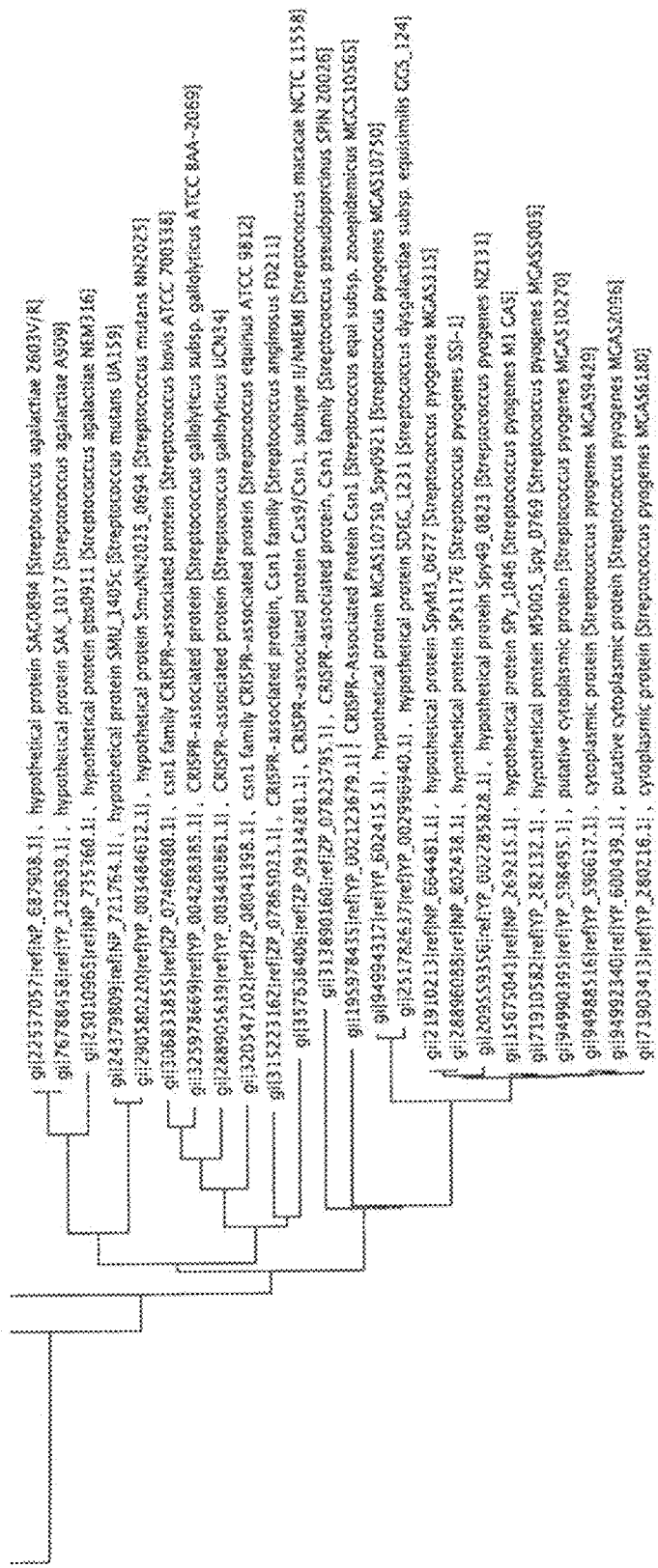
Figure 21A:
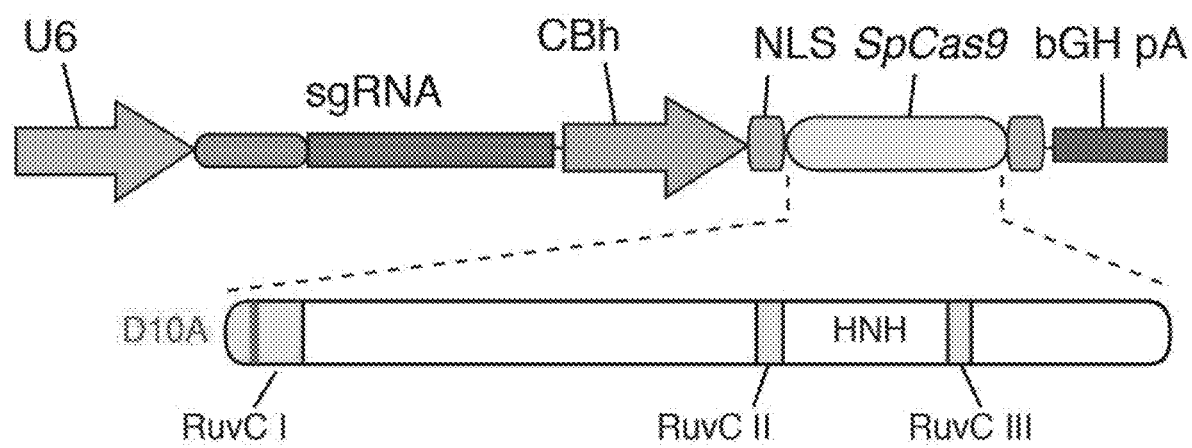
FIG. 21A-D shows genome editing via homologous recombination. (a) Schematic of SpCas9 nickase, with D10A mutation in the RuvC I catalytic domain. (b) Schematic representing homologous recombination (HR) at the human EMX1 locus using either sense or antisense single stranded oligonucleotides as repair templates. Red arrow above indicates sgRNA cleavage site; PCR primers for genotyping (Tables J and K) are indicated as arrows in right panel. (c) Sequence of region modified by HR. d, SURVEYOR assay for wildtype (wt) and nickase (D10A) SpCas9-mediated indels at the EMX1 target 1 locus (n=3). Arrows indicate positions of expected fragment sizes.
Figure 21B:
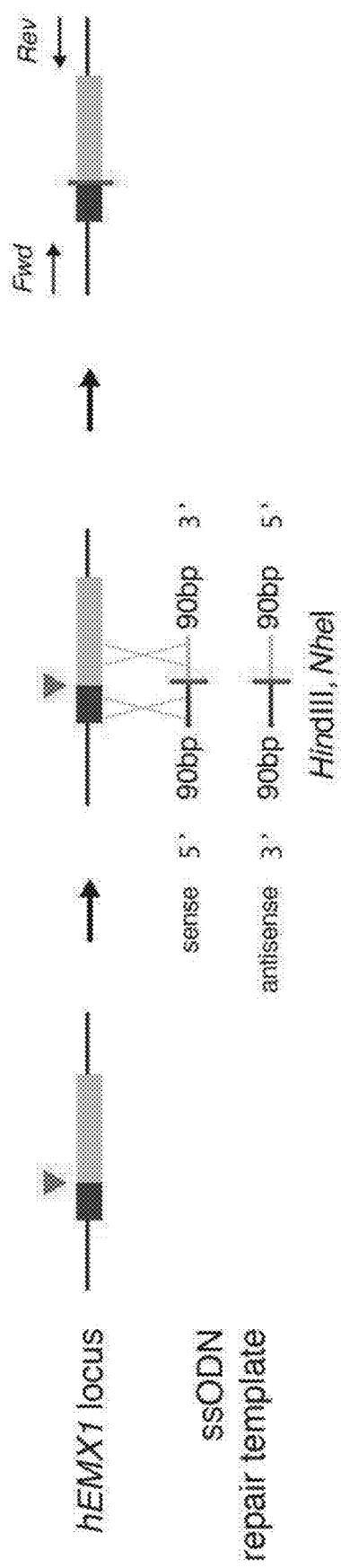
Figure 21C:
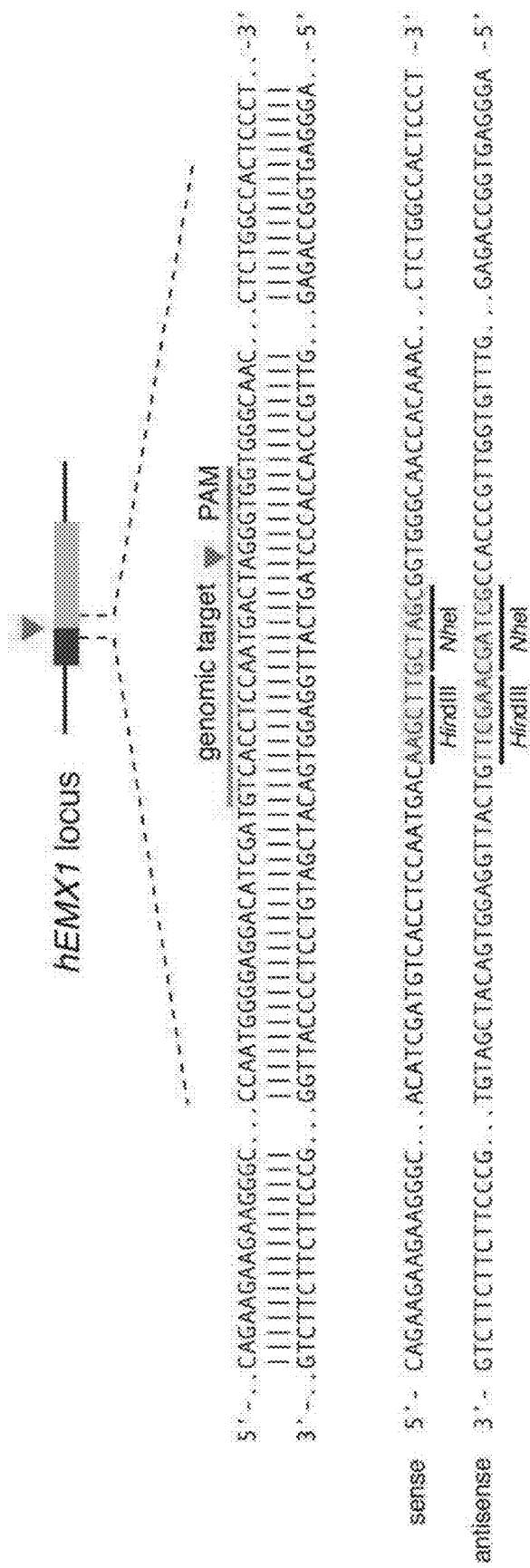
Figure 21D:
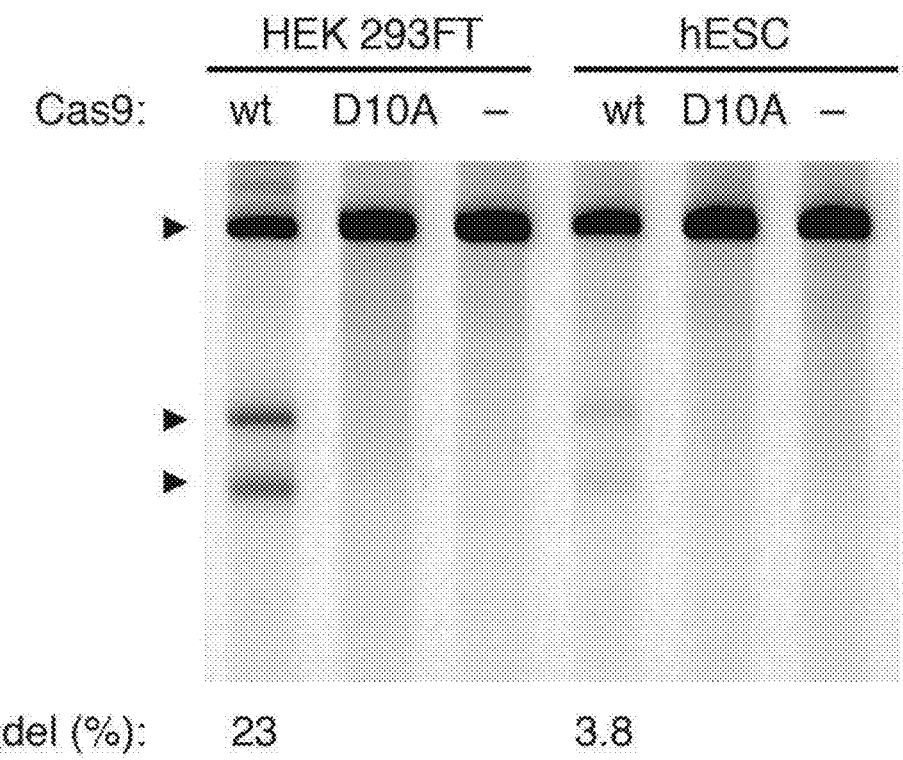

Since multiple occurrences in the genome of the DNA target site may lead to nonspecific genome editing, after identifying all potential sites, the program filters out sequences based on the number of times they appear in the relevant reference genome. For those CRISPR enzymes for which sequence specificity is determined by a 'seed' sequence, such as the 11-12 bp 5' from the PAM sequence, including the PAM sequence itself, the filtering step may be based on the seed sequence. Thus, to avoid editing at additional genomic loci, results are filtered based on the number of occurrences of the seed:PAM sequence in the relevant genome. The user may be allowed to choose the length of the seed sequence. The user may also be allowed to specify the number of occurrences of the seed:PAM sequence in a genome for purposes of passing the filter. The default is to screen for unique sequences. Filtration level is altered by changing both the length of the seed sequence and the number of occurrences of the sequence in the genome. The program may in addition or alternatively provide the sequence of a guide sequence complementary to the reported target sequence(s) by providing the reverse complement of the identified target sequence(s). An example visualization of some target sites in the human genome is provided in FIG. 18.

Further details of methods and algorithms to optimize sequence selection can be found in U.S. application Ser. No. 61/064,798; incorporated herein by reference.

Example 4: Evaluation of Multiple Chimeric crRNA-tracrRNA Hybrids

Figure 16A:
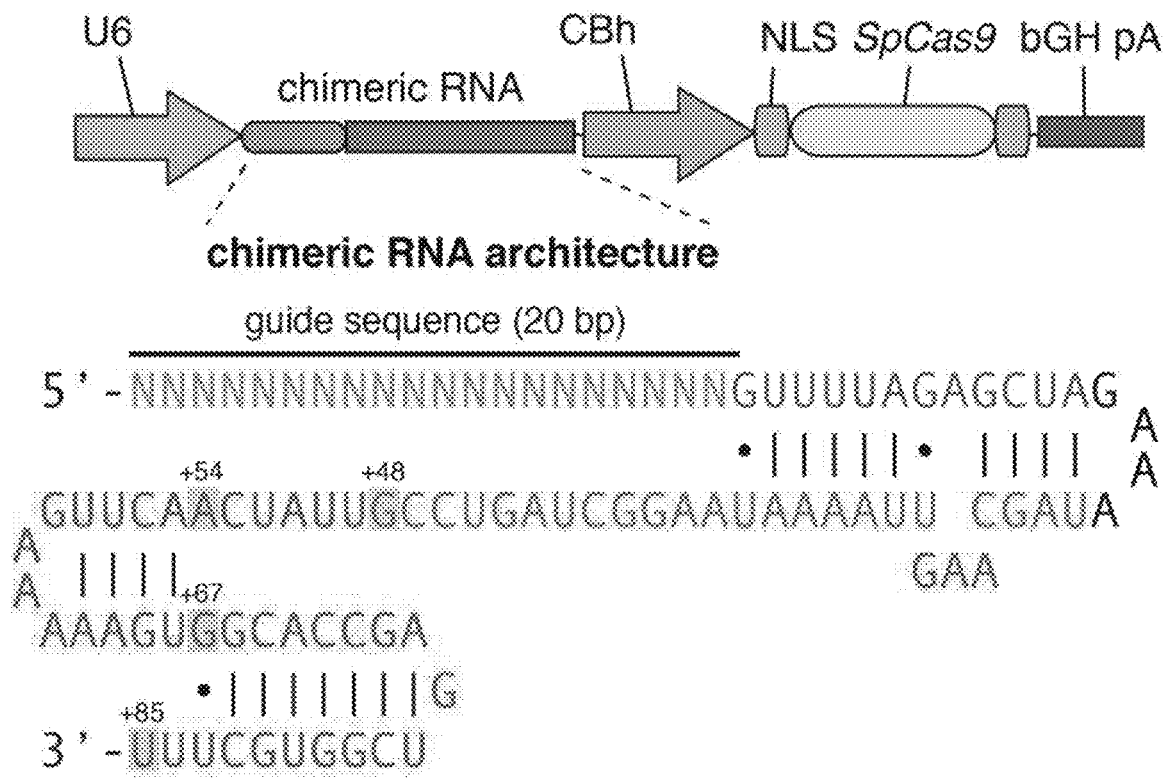
FIG. 16A-C shows exemplary manipulation of a CRISPR system with chimeric RNAs and results of SURVEYOR assays for system activity in eukaryotic cells.
Figure 16B:
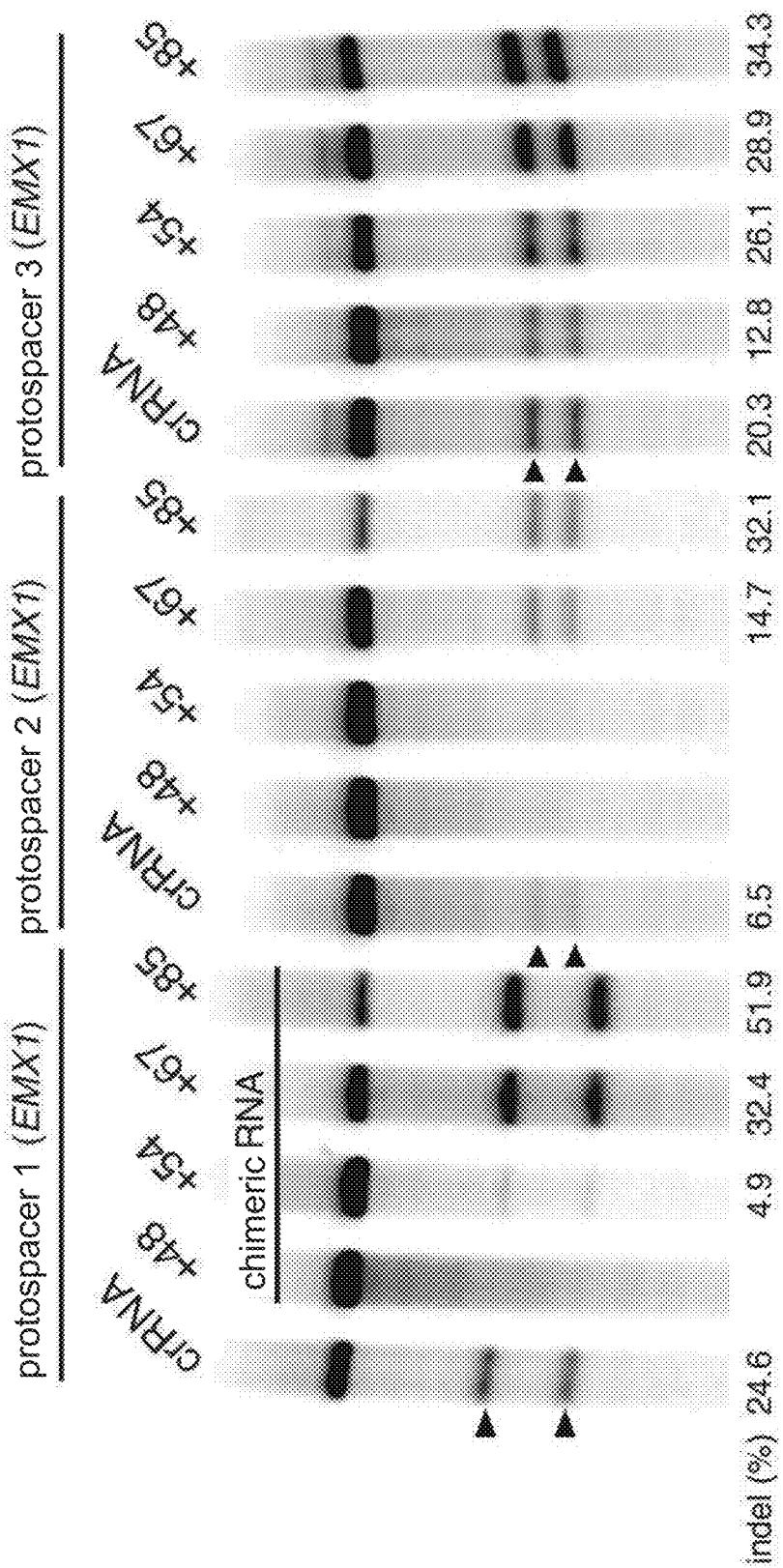
Figure 16C:
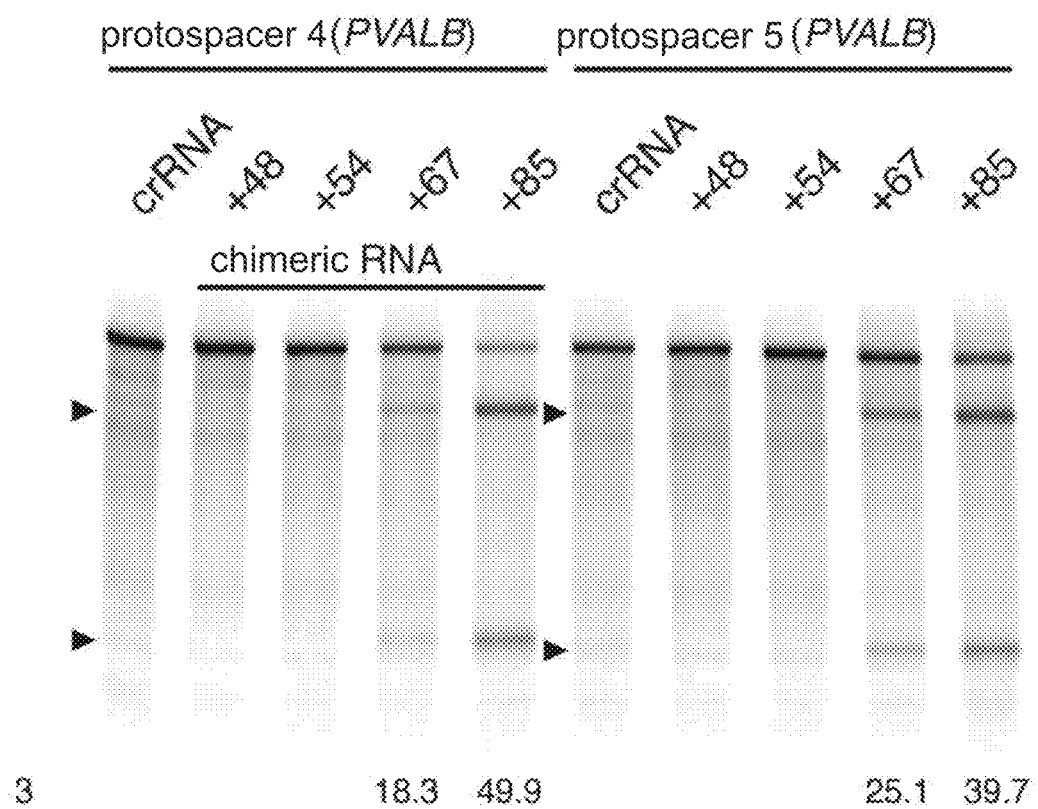

This example describes results obtained for chimeric RNAs (chiRNAs; comprising a guide sequence, a tracr mate sequence, and a tracr sequence in a single transcript) having tracr sequences that incorporate different lengths of wild-type tracrRNA sequence. FIG. 16a illustrates a schematic of a bicistronic expression vector for chimeric RNA and Cas9. Cas9 is driven by the CBh promoter and the chimeric RNA is driven by a U6 promoter. The chimeric guide RNA consists of a 20 bp guide sequence (Ns) joined to the tracr sequence (running from the first "U" of the lower strand to the end of the transcript), which is truncated at various positions as indicated. The guide and tracr sequences are separated by the tracr-mate sequence GUUUUAGAGCUA (SEQ ID NO: 41) followed by the loop sequence GAAA. Results of SURVEYOR assays for Cas9-mediated indels at the human EMX1 and PVALB loci are illustrated in FIGS. 16b and 16c, respectively. Arrows indicate the expected SURVEYOR fragments. ChiRNAs are indicated by their "+n" designation, and crRNA refers to a hybrid RNA where guide and tracr sequences are expressed as separate transcripts. Quantification of these results, performed in triplicate, are illustrated by histogram in FIGS. 17a and 17b, corresponding to FIGS. 16b and 16c, respectively ("N.D." indicates no indels detected). Protospacer IDs and their corresponding genomic target, protospacer sequence, PAM sequence, and strand location are provided in Table D. Guide sequences were designed to be complementary to the entire protospacer sequence in the case of separate transcripts in the hybrid system, or only to the underlined portion in the case of chimeric RNAs.

TABLE D

| protospacer ID | genomic target | protospacer sequence (5' to 3') | PAM | SEQ ID NO: | strand |
|---|---|---|---|---|---|
| 1 | EMX1 | GGACATCGAT<u>GTCACCTCCAATGACTAGGG</u> | TGG | 42 | + |
| 2 | EMX1 | CATTGGAGGT<u>GACATCGATGTCCTCCCCAT</u> | TGG | 43 | - |
| 3 | EMX1 | GGAAGGGCCT<u>GAGTCCGAGCAGAAGAAGAA</u> | GGG | 44 | + |
| 4 | PVALB | GGTGGCGAGA<u>GGGGCCGAGATTGGGTGTTC</u> | AGG | 45 | + |
| 5 | PVALB | ATGCAGGAG<u>GGTGGCGAGAGGGGCCGAGAT</u> | TGG | 46 | + |

Further details to optimize guide sequences can be found in U.S. application Ser. No. 61/836,127; incorporated herein by reference.

Figure 17B:
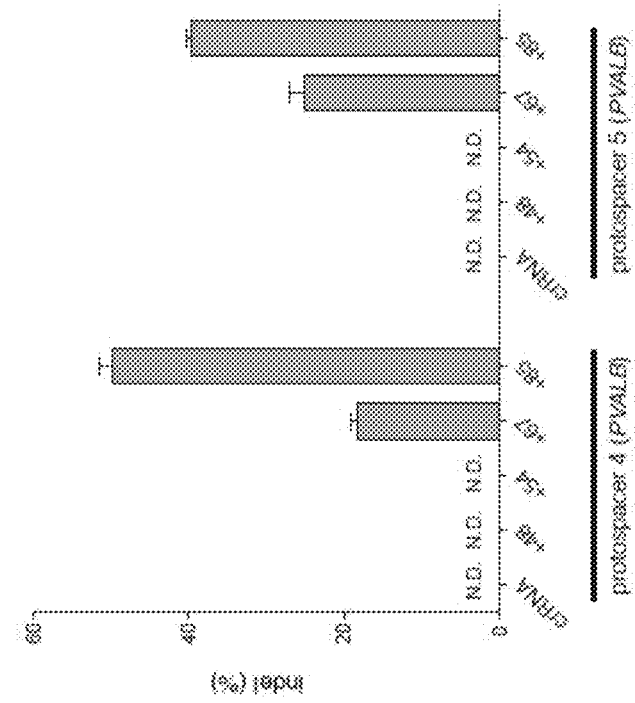
FIG. 17A-B shows a graphical representation of the results of SURVEYOR assays for CRISPR system activity in eukaryotic cells.
Figure 17A:
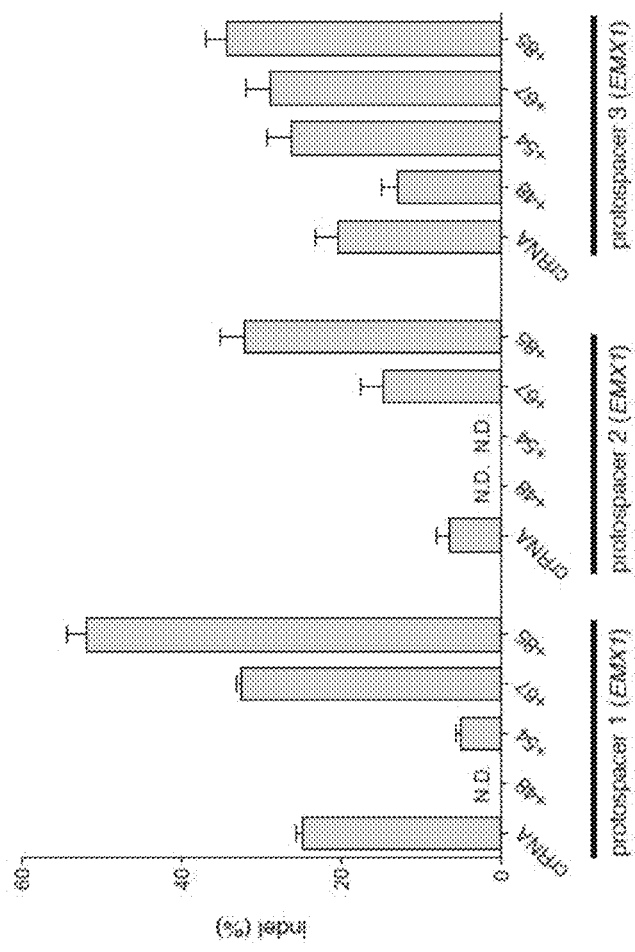

Initially, three sites within the EMX1 locus in human HEK 293FT cells were targeted. Genome modification efficiency of each chiRNA was assessed using the SURVEYOR nuclease assay, which detects mutations resulting from DNA double-strand breaks (DSBs) and their subsequent repair by the non-homologous end joining (NHEJ) DNA damage repair pathway. Constructs designated chiRNA(+n) indicate that up to the +n nucleotide of wild-type tracrRNA is included in the chimeric RNA construct, with values of 48, 54, 67, and 85 used for n. Chimeric RNAs containing longer fragments of wild-type tracrRNA (chiRNA(+67) and chiRNA(+85)) mediated DNA cleavage at all three EMX1 target sites, with chiRNA(+85) in particular demonstrating significantly higher levels of DNA cleavage than the corresponding crRNA/tracrRNA hybrids that expressed guide and tracr sequences in separate transcripts (FIGS. 16b and 17a). Two sites in the PVALB locus that yielded no detectable cleavage using the hybrid system (guide sequence and tracr sequence expressed as separate transcripts) were also targeted using chiRNAs. chiRNA(+67) and chiRNA(+85) were able to mediate significant cleavage at the two PVALB protospacers (FIGS. 16c and 17b).

For all five targets in the EMX1 and PVALB loci, a consistent increase in genome modification efficiency with increasing tracr sequence length was observed. Without wishing to be bound by any theory, the secondary structure formed by the 3' end of the tracrRNA may play a role in enhancing the rate of CRISPR complex formation.

Example 5: Cas9 Diversity

The CRISPR-Cas system is an adaptive immune mechanism against invading exogenous DNA employed by diverse species across bacteria and archaea. The type II CRISPR-Cas9 system consists of a set of genes encoding proteins responsible for the "acquisition" of foreign DNA into the CRISPR locus, as well as a set of genes encoding the "execution" of the DNA cleavage mechanism; these include the DNA nuclease (Cas9), a non-coding transactivating cr-RNA (tracrRNA), and an array of foreign DNA-derived spacers flanked by direct repeats (crRNAs). Upon maturation by Cas9, the tracRNA and crRNA duplex guide the Cas9 nuclease to a target DNA sequence specified by the spacer guide sequences, and mediates double-stranded breaks in the DNA near a short sequence motif in the target DNA that is required for cleavage and specific to each CRISPR-Cas system. The type II CRISPR-Cas systems are found throughout the bacterial kingdom and highly diverse in Cas9 protein sequence and size, tracrRNA and crRNA direct repeat sequence, genome organization of these elements, and the motif requirement for target cleavage. One species may have multiple distinct CRISPR-Cas systems.

Applicants evaluated 207 putative Cas9s from bacterial species identified based on sequence homology to known Cas9s and structures orthologous to known subdomains, including the HNH endonuclease domain and the RuvC endonuclease domains [information from the Eugene Koonin and Kira Makarova]. Phylogenetic analysis based on the protein sequence conservation of this set revealed five families of Cas9s, including three groups of large Cas9s (~1400 amino acids) and two of small Cas9s (~1100 amino acids) (see FIGS. 19 and 20A-F).

Further details of Cas9s and mutations of the Cas9 enzyme to convert into a nickase or DNA binding protein and use of same with altered functionality can be found in U.S. application Ser. Nos. 61/836,101 and 61/835,936 incorporated herein by reference.

Example 6: Cas9 Orthologs

Applicants analyzed Cas9 orthologs to identify the relevant PAM sequences and the corresponding chimeric guide RNA. Having an expanded set of PAMs provides broader targeting across the genome and also significantly increases the number of unique target sites and provides potential for identifying novel Cas9s with increased levels of specificity in the genome.

The specificity of Cas9 orthologs can be evaluated by testing the ability of each Cas9 to tolerate mismatches between the guide RNA and its DNA target. For example, the specificity of SpCas9 has been characterized by testing the effect of mutations in the guide RNA on cleavage efficiency. Libraries of guide RNAs were made with single or multiple mismatches between the guide sequence and the target DNA. Based on these findings, target sites for SpCas9 can be selected based on the following guidelines:

To maximize SpCas9 specificity for editing a particular gene, one should choose a target site within the locus of interest such that potential 'off-target' genomic sequences abide by the following four constraints: First and foremost, they should not be followed by a PAM with either 5'-NGG or NAG sequences. Second, their global sequence similarity to the target sequence should be minimized. Third, a maximal number of mismatches should lie within the PAM-proximal region of the off-target site. Finally, a maximal number of mismatches should be consecutive or spaced less than four bases apart.

Similar methods can be used to evaluate the specificity of other Cas9 orthologs and to establish criteria for the selection of specific target sites within the genomes of target species. As mentioned previously phylogenetic analysis based on the protein sequence conservation of this set revealed five families of Cas9s, including three groups of large Cas9s (1400 amino acids) and two of small Cas9s (1100 amino acids) (see FIGS. 19 and 20A-F). Further details on Cas orthologs can be found in U.S. application Ser. Nos. 61/836,101 and 61/835,936 incorporated herein by reference.

Example 7: Engineering of Plants (Micro-Algae) Using Cas9 to Target and Manipulate Plant Genes Methods of Delivering Cas9

Method 1: Applicants deliver Cas9 and guide RNA using a vector that expresses Cas9 under the control of a constitutive promoter such as Hsp70A-Rbc S2 or Beta2-tubulin.

Method 2: Applicants deliver Cas9 and T7 polymerase using vectors that expresses Cas9 and T7 polymerase under the control of a constitutive promoter such as Hsp70A-Rbc S2 or Beta2-tubulin. Guide RNA will be delivered using a vector containing T7 promoter driving the guide RNA.

Method 3: Applicants deliver Cas9 mRNA and in vitro transcribed guide RNA to algae cells. RNA can be in vitro transcribed. Cas9 mRNA will consist of the coding region for Cas9 as well as 3'UTR from Cop1 to ensure stabilization of the Cas9 mRNA.

For Homologous recombination, Applicants provide an additional homology directed repair template.

Sequence for a cassette driving the expression of Cas9 under the control of beta-2 tubulin promoter, followed by the 3' UTR of Cop1.

```
                                            (SEQ ID NO: 47)
TCTTTCTTGCGCTATGACACTTCCAGCAAAAGGTAGGGCGGGCTGCGAGA

CGGCTTCCCGGCGCTGCATGCAACACCGATGATGCTTCGACCCCCCGAAG

CTCCTTCGGGGCTGCATGGGCGCTCCGATGCCGCTCCAGGGCGAGCGCTG

TTTAAATAGCCAGGCCCCCGATTGCAAAGACATTATAGCGAGCTACCAAA

GCCATATTCAAACACCTAGATCACTACCACTTCTACACAGGCCACTCGAG

CTTGTGATCGCACTCCGCTAAGGGGGCGCCTCTTCCTCTTCGTTTCAGTC

ACAACCCGCAAACATGTACCCATACGATGTTCCAGATTACGCTTCGCCGA

AGAAAAAGCGCAAGGTCGAAGCGTCCGACAAGAAGTACAGCATCGGCCTG

GACATCGGCACCAACTCTGTGGGCTGGGCCGTGATCACCGACGAGTACAA

GGTGCCCAGCAAGAAATTCAAGGTGCTGGGCAACACCGACCGGCACAGCA

TCAAGAAGAACCTGATCGGAGCCCTGCTGTTCGACAGCGGCGAAACAGCC

GAGGCCACCCGGCTGAAGAGAACCGCCAGAAGAAGATACACCAGACGGAA

GAACCGGATCTGCTATCTGCAAGAGATCTTCAGCAACGAGATGGCCAAGG

TGGACGACAGCTTCTTCCACAGACTGGAAGAGTCCTTCCTGGTGGAAGAG

GATAAGAAGCACGAGCGGCACCCCATCTTCGGCAACATCGTGGACGAGGT

GGCCTACCACGAGAAGTACCCCACCATCTACCACCTGAGAAAGAAACTGG

TGGACAGCACCGACAAGGCCGACCTGCGGCTGATCTATCTGGCCCTGGCC

CACATGATCAAGTTCCGGGGCCACTTCCTGATCGAGGGCGACCTGAACCC

CGACAACAGCGACGTGGACAAGCTGTTCATCCAGCTGGTGCAGACCTACA

ACCAGCTGTTCGAGGAAAACCCCATCAACGCCAGCGGCGTGGACGCCAAG

GCCATCCTGTCTGCCAGACTGAGCAAGAGCAGACGGCTGGAAAATCTGAT

CGCCCAGCTGCCCGGCGAGAAGAAGAATGGCCTGTTCGGCAACCTGATTG

CCCTGAGCCTGGGCCTGACCCCCAACTTCAAGAGCAACTTCGACCTGGCC

GAGGATGCCAAACTGCAGCTGAGCAAGGACACCTACGACGACGACCTGGA

CAACCTGCTGGCCCAGATCGGCGACCAGTACGCCGACCTGTTTCTGGCCG

CCAAGAACCTGTCCGACGCCATCCTGCTGAGCGACATCCTGAGAGTGAAC

ACCGAGATCACCAAGGCCCCCCTGAGCGCCTCTATGATCAAGAGATACGA

CGAGCACCACCAGGACCTGACCCTGCTGAAAGCTCTCGTGCGGCAGCAGC

TGCCTGAGAAGTACAAAGAGATTTTCTTCGACCAGAGCAAGAACGGCTAC

GCCGGCTACATTGACGGCGGAGCCAGCCAGGAAGAGTTCTACAAGTTCAT

CAAGCCCATCCTGGAAAAGATGGACGGCACCGAGGAACTGCTCGTGAAGC

TGAACAGAGAGGACCTGCTGCGGAAGCAGCGGACCTTCGACAACGGCAGC

ATCCCCCACCAGATCCACCTGGGAGAGCTGCACGCCATTCTGCGGCGGCA

GGAAGATTTTTACCCATTCCTGAAGGACAACCGGGAAAAGATCGAGAAGA

TCCTGACCTTCCGCATCCCCTACTACGTGGGCCCTCTGGCCAGGGGAAAC

AGCAGATTCGCCTGGATGACCAGAAAGAGCGAGGAAACCATCACCCCCTG

GAACTTCGAGGAAGTGGTGGACAAGGGCGCTTCCGCCCAGAGCTTCATCG

AGCGGATGACCAACTTCGATAAGAACCTGCCCAACGAGAAGGTGCTGCCC

AAGCACAGCCTGCTGTACGAGTACTTCACCGTGTATAACGAGCTGACCAA

AGTGAAATACGTGACCGAGGGAATGAGAAAGCCCGCCTTCCTGAGCGGCG

AGCAGAAAAAGGCCATCGTGGACCTGCTGTTCAAGACCAACCGGAAAGTG

ACCGTGAAGCAGCTGAAAGAGGACTACTTCAAGAAAATCGAGTGCTTCGA

CTCCGTGGAAATCTCCGGCGTGGAAGATCGGTTCAACGCCTCCCTGGGCA

CATACCACGATCTGCTGAAAATTATCAAGGACAAGGACTTCCTGGACAAT

GAGGAAAACGAGGACATTCTGGAAGATATCGTGCTGACCCTGACACTGTT

TGAGGACAGAGAGATGATCGAGGAACGGCTGAAAACCTATGCCCACCTGT

TCGACGACAAAGTGATGAAGCAGCTGAAGCGGCGGAGATACACCGGCTGG

GGCAGGCTGAGCCGGAAGCTGATCAACGGCATCCGGGACAAGCAGTCCGG

CAAGACAATCCTGGATTTCCTGAAGTCCGACGGCTTCGCCAACAGAAACT

TCATGCAGCTGATCCACGACGACAGCCTGACCTTTAAAGAGGACATCCAG

AAAGCCCAGGTGTCCGGCCAGGGCGATAGCCTGCACGAGCACATTGCCAA

TCTGGCCGGCAGCCCCGCCATTAAGAAGGGCATCCTGCAGACAGTGAAGG

TGGTGGACGAGCTCGTGAAAGTGATGGGCCGGCACAAGCCCGAGAACATC

GTGATCGAAATGGCCAGAGAGAACCAGACCACCCAGAAGGGACAGAAGAA

CAGCCGCGAGAGAATGAAGCGGATCGAAGAGGGCATCAAAGAGCTGGGCA

GCCAGATCCTGAAAGAACACCCCGTGGAAAACACCCAGCTGCAGAACGAG

AAGCTGTACCTGTACTACCTGCAGAATGGGCGGGATATGTACGTGGACCA

GGAACTGGACATCAACCGGCTGTCCGACTACGATGTGGACCATATCGTGC

CTCAGAGCTTTCTGAAGGACGACTCCATCGACAACAAGGTGCTGACCAGA

AGCGACAAGAACCGGGGCAAGAGCGACAACGTGCCCTCCGAAGAGGTCGT

GAAGAAGATGAAGAACTACTGGCGGCAGCTGCTGAACGCCAAGCTGATTA
```

```
CCCAGAGAAAGTTCGACAATCTGACCAAGGCCGAGAGAGGCGGCCTGAGC
GAACTGGATAAGGCCGGCTTCATCAAGAGACAGCTGGTGGAAACCCGGCA
GATCACAAAGCACGTGGCACAGATCCTGGACTCCCGGATGAACACTAAGT
ACGACGAGAATGACAAGCTGATCCGGGAAGTGAAAGTGATCACCCTGAAG
TCCAAGCTGGTGTCCGATTTCCGGAAGGATTTCCAGTTTTACAAAGTGCG
CGAGATCAACAACTACCACCACGCCCACGACGCCTACCTGAACGCCGTCG
TGGGAACCGCCCTGATCAAAAAGTACCCTAAGCTGGAAAGCGAGTTCGTG
TACGGCGACTACAAGGTGTACGACGTGCGGAAGATGATCGCCAAGAGCGA
GCAGGAAATCGGCAAGGCTACCGCCAAGTACTTCTTCTACAGCAACATCA
TGAACTTTTTCAAGACCGAGATTACCCTGGCCAACGGCGAGATCCGGAAG
CGGCCTCTGATCGAGACAAACGGCGAAACCGGGGAGATCGTGTGGGATAA
GGGCCGGGATTTTGCCACCGTGCGGAAAGTGCTGAGCATGCCCCAAGTGA
ATATCGTGAAAAAGACCGAGGTGCAGACAGGCGGCTTCAGCAAAGAGTCT
ATCCTGCCCAAGAGGAACAGCGATAAGCTGATCGCCAGAAAGAAGGACTG
GGACCCTAAGAAGTACGGCGGCTTCGACAGCCCCACCGTGGCCTATTCTG
TGCTGGTGGTGGCCAAAGTGGAAAAGGGCAAGTCCAAGAAACTGAAGAGT
GTGAAAGAGCTGCTGGGGATCACCATCATGGAAAGAAGCAGCTTCGAGAA
GAATCCCATCGACTTTCTGGAAGCCAAGGGCTACAAAGAAGTGAAAAAGG
ACCTGATCATCAAGCTGCCTAAGTACTCCCTGTTCGAGCTGGAAAACGGC
CGGAAGAGAATGCTGGCCTCTGCCGGCGAACTGCAGAAGGGAAACGAACT
GGCCCTGCCCTCCAAATATGTGAACTTCCTGTACCTGGCCAGCCACTATG
AGAAGCTGAAGGGCTCCCCCGAGGATAATGAGCAGAAACAGCTGTTTGTG
GAACAGCACAAGCACTACCTGGACGAGATCATCGAGCAGATCAGCGAGTT
CTCCAAGAGAGTGATCCTGGCCGACGCTAATCTGGACAAAGTGCTGTCCG
CCTACAACAAGCACCGGGATAAGCCCATCAGAGAGCAGGCCGAGAATATC
ATCCACCTGTTTACCCTGACCAATCTGGGAGCCCCTGCCGCCTTCAAGTA
CTTTGACACCACCATCGACCGGAAGAGGTACACCAGCACCAAAGAGGTGC
TGGACGCCACCCTGATCCACCAGAGCATCACCGGCCTGTACGAGACACGG
ATCGACCTGTCTCAGCTGGGAGGCGACAGCCCCAAGAAGAAGAGAAAGGT
GGAGGCCAGCTAAGGATCCGGCAAGACTGGCCCCGCTTGGCAACGCAACA
GTGAGCCCCTCCCTAGTGTGTTTGGGGATGTGACTATGTATTCGTGTGTT
GGCCAACGGGTCAACCCGAACAGATTGATACCCGCCTTGGCATTTCCTGT
CAGAATGTAACGTCAGTTGATGGTACT
```

Sequence for a cassette driving the expression of T7 polymerase under the control of beta-2 tubulin promoter, followed by the 3' UTR of Cop1:

(SEQ ID NO: 48)
```
TCTTTCTTGCGCTATGACACTTCCAGCAAAAGGTAGGGCGGGCTGCGAGA
CGGCTTCCCGGCGCTGCATGCAACACCGATGATGCTTCGACCCCCCGAAG
CTCCTTCGGGGCTGCATGGGCGCTCCGATGCCGCTCCAGGGCGAGCGCTG
TTTAAATAGCCAGGCCCCCGATTGCAAAGACATTATAGCGAGCTACCAAA
GCCATATTCAAACACCTAGATCACTACCACTTCTACACAGGCCACTCGAG
CTTGTGATCGCACTCCGCTAAGGGGGCGCCTCTTCCTCTTCGTTTCAGTC
ACAACCCGCAAACatgcctaagaagaagaggaaggttaacacgattaaca
tcgctaagaacgacttctctgacatcgaactggctgctatcccgttcaac
actctggctgaccattacggtgagcgtttagctcgcgaacagttggccct
tgagcatgagtcttacgagatgggtgaagcacgcttccgcaagatgtttg
agcgtcaacttaaagctggtgaggttgcggataacgctgccgccaagcct
ctcatcactaccctactccctaagatgattgcacgcatcaacgactggtt
tgaggaagtgaaagctaagcgcggcaagcgcccgacagccttccagttcc
tgcaagaaatcaagccggaagccgtagcgtacatcaccattaagaccact
ctggcttgcctaaccagtgctgacaatacaaccgttcaggctgtagcaag
cgcaatcggtcgggccattgaggacgaggctcgcttcggtcgtatccgtg
accttgaagctaagcacttcaagaaaaacgttgaggaacaactcaacaag
cgcgtagggcacgtctacaagaaagcatttatgcaagttgtcgaggctga
catgctctctaagggtctactcggtggcgaggcgtggtcttcgtggcata
aggaagactctattcatgtaggagtacgctgcatcgagatgctcattgag
tcaaccggaatggttagcttacaccgccaaaatgctggcgtagtaggtca
agactctgagactatcgaactcgcacctgaatacgctgaggctatcgcaa
cccgtgcaggtgcgctggctggcatctctccgatgttccaaccttgcgta
gttcctcctaagccgtggactggcattactggtggtggctattgggctaa
cggtcgtcgtcctctggcgctggtgcgtactcacagtaagaaagcactga
tgcgctacgaagacgtttacatgcctgaggtgtacaaagcgattaacatt
gcgcaaaacaccgcatggaaaatcaacaagaaagtcctagcggtcgccaa
cgtaatcaccaagtggaagcattgtccggtcgaggacatccctgcgattg
agcgtgaagaactcccgatgaaaccggaagacatcgacatgaatcctgag
gctctcaccgcgtggaaacgtgctgccgctgctgtgtaccgcaaggacaa
ggctcgcaagtctcgccgtatcagccttgagttcatgcttgagcaagcca
ataagtttgctaaccataaggccatctggttcccttacaacatggactgg
cgcggtcgtgtttacgctgtgtcaatgttcaacccgcaaggtaacgatat
gaccaaaggactgcttacgctggcgaaaggtaaaccaatcggtaaggaag
gttactactggctgaaaatccacggtgcaaactgtgcgggtgtcgacaag
gttccgttccctgagcgcatcaagttcattgaggaaaaccacgagaacat
catggcttgcgctaagtctccactggagaacacttggtgggctgagcaag
attctccgttctgcttccttgcgttctgctttgagtacgctggggtacag
caccacggcctgagctataactgctcccttccgctggcgtttgacgggtc
ttgctctggcatccagcacttctccgcgatgctccgagatgaggtaggtg
gtcgcgcggttaacttgcttcctagtgaaaccgttcaggacatctacggg
attgttgctaagaaagtcaacgagattctacaagcagacgcaatcaatgg
gaccgataacgaagtagttaccgtgaccgatgagaacactggtgaaatct
ctgagaaagtcaagctgggcactaaggcactggctggtcaatggctggct
tacggtgttactcgcagtgtgactaagcgttcagtcatgacgctggctta
``` cgggtccaaagagttcggcttccgtcaacaagtgctggaagataccattc agccagctattgattccggcaagggtctgatgttcactcagccgaatcag gctgctggatacatggctaagctgatttgggaatctgtgagcgtgacggt ggtagctgcggttgaagcaatgaactggcttaagtctgctgctaagctgc tggctgctgaggtcaaagataagaagactggagagattcttcgcaagcgt tgcgctgtgcattgggtaactcctgatggtttccctgtgtggcaggaata caagaagcctattcagacgcgcttgaacctgatgttcctcggtcagttcc gcttacagcctaccattaacaccaacaaagatagcgagattgatgcacac aaacaggagtctggtatcgctcctaactttgtacacagccaagacggtag ccaccttcgtaagactgtagtgtgggcacacgagaagtacggaatcgaat cttttgcactgattcacgactccttcggtacgattccggctgacgctgcg aacctgttcaaagcagtgcgcgaaactatggttgacacatatgagtcttg tgatgtactggctgatttctacgaccagttcgctgaccagttgcacgagt ctcaattggacaaaatgccagcacttccggctaaaggtaacttgaacctc cgtgacatcttagagtcggacttcgcgttcgcgtaaGGATCCGGCAAGAC

TGGCCCCGCTTGGCAACGCAACAGTGAGCCCCTCCCTAGTGTGTTTGGGG

ATGTGACTATGTATTCGTGTGTTGGCCAACGGGTCAACCCGAACAGATTG

ATACCCGCCTTGGCATTTCCTGTCAGAATGTAACGTCAGTTGATGGTACT

Sequence of guide RNA driven by the T7 promoter (T7 promoter, Ns represent targeting sequence):

(SEQ ID NO: 49)
gaaatTAATACGACTCACTATANNNNNNNNNNNNNNNNNNNNNgttttaga gctaGAAAtagcaagttaaaataaggctagtccgttatcaacttgaaaaa gtggcaccgagtcggtgctttttt Gene Delivery:
*Chlamydomonas reinhardtii* strain CC-124 and CC-125 from the *Chlamydomonas* Resource Center will be used for electroporation. Electroporation protocol follows standard recommended protocol from the GeneArt *Chlamydomonas* Engineering kit.

Also, Applicants generate a line of *Chlamydomonas reinhardtii* that expresses Cas9 constitutively. This can be done by using pChlamy1 (linearized using PvuI) and selecting for hygromycin resistant colonies. Sequence for pChlamy1 containing Cas9 is below. In this way to achieve gene knockout one simply needs to deliver RNA for the guideRNA. For homologous recombination Applicants deliver guideRNA as well as a linearized homologous recombination template.
pChlamy1-Cas9:

(SEQ ID NO: 50)
TGCGGTATTTCACACCGCATCAGGTGGCACTTTTCGGGGAAATGTGCGCG

GAACCCCTATTTGTTTATTTTTCTAAATACATTCAAATATGTATCCGCTC

ATGAGATTATCAAAAAGGATCTTCACCTAGATCCTTTTAAATTAAAAATG

AAGTTTTAAATCAATCTAAAGTATATATGAGTAAACTTGGTCTGACAGTT

ACCAATGCTTAATCAGTGAGGCACCTATCTCAGCGATCTGTCTATTTCGT

TCATCCATAGTTGCCTGACTCCCCGTCGTGTAGATAACTACGATACGGGA

GGGCTTACCATCTGGCCCCAGTGCTGCAATGATACCGCGAGACCCACGCT

CACCGGCTCCAGATTTATCAGCAATAAACCAGCCAGCCGGAAGGGCCGAG

CGCAGAAGTGGTCCTGCAACTTTATCCGCCTCCATCCAGTCTATTAATTG

TTGCCGGGAAGCTAGAGTAAGTAGTTCGCCAGTTAATAGTTTGCGCAACG

TTGTTGCCATTGCTACAGGCATCGTGGTGTCACGCTCGTCGTTTGGTATG

GCTTCATTCAGCTCCGGTTCCCAACGATCAAGGCGAGTTACATGATCCCC

CATGTTGTGCAAAAAAGCGGTTAGCTCCTTCGGTCCTCCGATCGTTGTCA

GAAGTAAGTTGGCCGCAGTGTTATCACTCATGGTTATGGCAGCACTGCAT

AATTCTCTTACTGTCATGCCATCCGTAAGATGCTTTTCTGTGACTGGTGA

GTACTCAACCAAGTCATTCTGAGAATAGTGTATGCGGCGACCGAGTTGCT

CTTGCCCGGCGTCAATACGGGATAATACCGCGCCACATAGCAGAACTTTA

AAAGTGCTCATCATTGGAAAACGTTCTTCGGGGCGAAAACTCTCAAGGAT

CTTACCGCTGTTGAGATCCAGTTCGATGTAACCCACTCGTGCACCCAACT

GATCTTCAGCATCTTTTACTTTCACCAGCGTTTCTGGGTGAGCAAAAACA

GGAAGGCAAAATGCCGCAAAAAAGGGAATAAGGGCGACACGGAAATGTTG

AATACTCATACTCTTCCTTTTTCAATATTATTGAAGCATTTATCAGGGTT

ATTGTCTCATGACCAAAATCCCTTAACGTGAGTTTTCGTTCCACTGAGCG

TCAGACCCCGTAGAAAAGATCAAAGGATCTTCTTGAGATCCTTTTTTTCT

GCGCGTAATCTGCTGCTTGCAAACAAAAAAACCACCGCTACCAGCGGTGG

TTTGTTTGCCGGATCAAGAGCTACCAACTCTTTTTCCGAAGGTAACTGGC

TTCAGCAGAGCGCAGATACCAAATACTGTTCTTCTAGTGTAGCCGTAGTT

AGGCCACCACTTCAAGAACTCTGTAGCACCGCCTACATACCTCGCTCTGC

TAATCCTGTTACCAGTGGCTGTTGCCAGTGGCGATAAGTCGTGTCTTACC

GGGTTGGACTCAAGACGATAGTTACCGGATAAGGCGCAGCGGTCGGGCTG

AACGGGGGGTTCGTGCACACAGCCCAGCTTGGAGCGAACGACCTACACCG

AACTGAGATACCTACAGCGTGAGCTATGAGAAAGCGCCACGCTTCCCGAA

GGGAGAAAGGCGGACAGGTATCCGGTAAGCGGCAGGGTCGGAACAGGAGA

GCGCACGAGGGAGCTTCCAGGGGGAAACGCCTGGTATCTTTATAGTCCTG

TCGGGTTTCGCCACCTCTGACTTGAGCGTCGATTTTTGTGATGCTCGTCA

GGGGGGCGGAGCCTATGGAAAAACGCCAGCAACGCGGCCTTTTTACGGTT

CCTGGCCTTTTGCTGGCCTTTTGCTCACATGTTCTTTCCTGCGTTATCCC

CTGATTCTGTGGATAACCGTATTACCGCCTTTGAGTGAGCTGATACCGCT

CGCCGCAGCCGAACGACCGAGCGCAGCGAGTCAGTGAGCGAGGAAGCGGT

CGCTGAGGCTTGACATGATTGGTGCGTATGTTTGTATGAAGCTACAGGAC

TGATTTGGCGGGCTATGAGGGCGGGGAAGCTCTGGAAGGGCCGCGATGG

GGCGCGCGGCGTCCAGAAGGCGCCATACGGCCCGCTGGCGGCACCCATCC

GGTATAAAAGCCCGCGACCCCGAACGGTGACCTCCACTTTCAGCGACAAA

CGAGCACTTATACATACGCGACTATTCTGCCGCTATACATAACCACTCAG

CTAGCTTAAGATCCCATCAAGCTTGCATGCCGGGCGCGCCAGAAGGAGCG

CAGCCAAACCAGGATGATGTTTGATGGGGTATTTGAGCACTTGCAACCCT

-continued

TATCCGGAAGCCCCCTGGCCCACAAAGGCTAGGCGCCAATGCAAGCAGTT
CGCATGCAGCCCCTGGAGCGGTGCCCTCCTGATAAACCGGCCAGGGGCC
TATGTTCTTTACTTTTTTACAAGAGAAGTCACTCAACATCTTAAAATGGC
CAGGTGAGTCGACGAGCAAGCCCGGCGGATCAGGCAGCGTGCTTGCAGAT
TTGACTTGCAACGCCCGCATTGTGTCGACGAAGGCTTTTGGCTCCTCTGT
CGCTGTCTCAAGCAGCATCTAACCCTGCTCGCCGTTTCCATTTGCAGGA
GATTCGAGGTACCATGTACCCATACGATGTTCCAGATTACGCTTCGCCGA
AGAAAAAGCGCAAGGTCGAAGCGTCCGACAAGAAGTACAGCATCGGCCTG
GACATCGGCACCAACTCTGTGGGCTGGGCCGTGATCACCGACGAGTACAA
GGTGCCCAGCAAGAAATTCAAGGTGCTGGGCAACACCGACCGGCACAGCA
TCAAGAAGAACCTGATCGGAGCCCTGCTGTTCGACAGCGGCGAAACAGCC
GAGGCCACCCGGCTGAAGAGAACCGCCAGAAGAAGATACACCAGACGGAA
GAACCGGATCTGCTATCTGCAAGAGATCTTCAGCAACGAGATGGCCAAGG
TGGACGACAGCTTCTTCCACAGACTGGAAGAGTCCTTCCTGGTGGAAGAG
GATAAGAAGCACGAGCGGCACCCCATCTTCGGCAACATCGTGGACGAGGT
GGCCTACCACGAGAAGTACCCCACCATCTACCACCTGAGAAAGAAACTGG
TGGACAGCACCGACAAGGCCGACCTGCGGCTGATCTATCTGGCCCTGGCC
CACATGATCAAGTTCCGGGGCCACTTCCTGATCGAGGGCGACCTGAACCC
CGACAACAGCGACGTGGACAAGCTGTTCATCCAGCTGGTGCAGACCTACA
ACCAGCTGTTCGAGGAAAACCCCATCAACGCCAGCGGCGTGGACGCCAAG
GCCATCCTGTCTGCCAGACTGAGCAAGAGCAGACGGCTGGAAAATCTGAT
CGCCCAGCTGCCCGGCGAGAAGAAGAATGGCCTGTTCGGCAACCTGATTG
CCCTGAGCCTGGGCCTGACCCCCAACTTCAAGAGCAACTTCGACCTGGCC
GAGGATGCCAAACTGCAGCTGAGCAAGGACACCTACGACGACGACCTGGA
CAACCTGCTGGCCCAGATCGGCGACCAGTACGCCGACCTGTTTCTGGCCG
CCAAGAACCTGTCCGACGCCATCCTGCTGAGCGACATCCTGAGAGTGAAC
ACCGAGATCACCAAGGCCCCCCTGAGCGCCTCTATGATCAAGAGATACGA
CGAGCACCACCAGGACCTGACCCTGCTGAAAGCTCTCGTGCGGCAGCAGC
TGCCTGAGAAGTACAAAGAGATTTTCTTCGACCAGAGCAAGAACGGCTAC
GCCGGCTACATTGACGGCGGAGCCAGCCAGGAAGAGTTCTACAAGTTCAT
CAAGCCCATCCTGGAAAAGATGGACGGCACCGAGGAACTGCTCGTGAAGC
TGAACAGAGAGGACCTGCTGCGGAAGCAGCGGACCTTCGACAACGGCAGC
ATCCCCCACCAGATCCACCTGGGAGAGCTGCACGCCATTCTGCGGCGGCA
GGAAGATTTTTACCCATTCCTGAAGGACAACCGGGAAAAGATCGAGAAGA
TCCTGACCTTCCGCATCCCCTACTACGTGGGCCCTCTGGCCAGGGGAAAC
AGCAGATTCGCCTGGATGACCAGAAAGAGCGAGGAAACCATCACCCCCTG
GAACTTCGAGGAAGTGGTGGACAAGGGCGCTTCCGCCCAGAGCTTCATCG
AGCGGATGACCAACTTCGATAAGAACCTGCCCAACGAGAAGGTGCTGCCC
AAGCACAGCCTGCTGTACGAGTACTTCACCGTGTATAACGAGCTGACCAA
AGTGAAATACGTGACCGAGGGAATGAGAAAGCCCGCCTTCCTGAGCGGCG

-continued

AGCAGAAAAAGGCCATCGTGGACCTGCTGTTCAAGACCAACCGGAAAGTG
ACCGTGAAGCAGCTGAAAGAGGACTACTTCAAGAAAATCGAGTGCTTCGA
CTCCGTGGAAATCTCCGGCGTGGAAGATCGGTTCAACGCCTCCCTGGGCA
CATACCACGATCTGCTGAAAATTATCAAGGACAAGGACTTCCTGGACAAT
GAGGAAAACGAGGACATTCTGGAAGATATCGTGCTGACCCTGACACTGTT
TGAGGACAGAGAGATGATCGAGGAACGGCTGAAAACCTATGCCCACCTGT
TCGACGACAAAGTGATGAAGCAGCTGAAGCGGCGGAGATACACCGGCTGG
GGCAGGCTGAGCCGGAAGCTGATCAACGGCATCCGGGACAAGCAGTCCGG
CAAGACAATCCTGGATTTCCTGAAGTCCGACGGCTTCGCCAACAGAAACT
TCATGCAGCTGATCCACGACGACAGCCTGACCTTTAAAGAGGACATCCAG
AAAGCCCAGGTGTCCGGCCAGGGCGATAGCCTGCACGAGCACATTGCCAA
TCTGGCCGGCAGCCCCGCCATTAAGAAGGGCATCCTGCAGACAGTGAAGG
TGGTGGACGAGCTCGTGAAAGTGATGGGCCGGCACAAGCCCGAGAACATC
GTGATCGAAATGGCCAGAGAGAACCAGACCACCCAGAAGGGACAGAAGAA
CAGCCGCGAGAGAATGAAGCGGATCGAAGAGGGCATCAAAGAGCTGGGCA
GCCAGATCCTGAAAGAACACCCCGTGGAAAACACCCAGCTGCAGAACGAG
AAGCTGTACCTGTACTACCTGCAGAATGGGCGGGATATGTACGTGGACCA
GGAACTGGACATCAACCGGCTGTCCGACTACGATGTGGACCATATCGTGC
CTCAGAGCTTTCTGAAGGACGACTCCATCGACAACAAGGTGCTGACCAGA
AGCGACAAGAACCGGGGCAAGAGCGACAACGTGCCCTCCGAAGAGGTCGT
GAAGAAGATGAAGAACTACTGGCGGCAGCTGCTGAACGCCAAGCTGATTA
CCCAGAGAAAGTTCGACAATCTGACCAAGGCCGAGAGAGGCGGCCTGAGC
GAACTGGATAAGGCCGGCTTCATCAAGAGACAGCTGGTGGAAACCCGGCA
GATCACAAAGCACGTGGCACAGATCCTGGACTCCCGGATGAACACTAAGT
ACGACGAGAATGACAAGCTGATCCGGGAAGTGAAAGTGATCACCCTGAAG
TCCAAGCTGGTGTCCGATTTCCGGAAGGATTTCCAGTTTTACAAAGTGCG
CGAGATCAACAACTACCACCACGCCCACGACGCCTACCTGAACGCCGTCG
TGGGAACCGCCCTGATCAAAAAGTACCCTAAGCTGGAAAGCGAGTTCGTG
TACGGCGACTACAAGGTGTACGACGTGCGGAAGATGATCGCCAAGAGCGA
GCAGGAAATCGGCAAGGCTACCGCCAAGTACTTCTTCTACAGCAACATCA
TGAACTTTTTCAAGACCGAGATTACCCTGGCCAACGGCGAGATCCGGAAG
CGGCCTCTGATCGAGACAAACGGCGAAACCGGGGAGATCGTGTGGGATAA
GGGCCGGGATTTTGCCACCGTGCGGAAAGTGCTGAGCATGCCCCAAGTGA
ATATCGTGAAAAAGACCGAGGTGCAGACAGGCGGCTTCAGCAAAGAGTCT
ATCCTGCCCAAGAGGAACAGCGATAAGCTGATCGCCAGAAAGAAGGACTG
GGACCCTAAGAAGTACGGCGGCTTCGACAGCCCCACCGTGGCCTATTCTG
TGCTGGTGGTGGCCAAAGTGGAAAAGGGCAAGTCCAAGAAACTGAAGAGT
GTGAAAGAGCTGCTGGGGATCACCATCATGGAAAGAAGCAGCTTCGAGAA
GAATCCCATCGACTTTCTGGAAGCCAAGGGCTACAAAGAAGTGAAAAAGG
ACCTGATCATCAAGCTGCCTAAGTACTCCCTGTTCGAGCTGGAAAACGGC
CGGAAGAGAATGCTGGCCTCTGCCGGCGAACTGCAGAAGGGAAACGAACT

-continued

```
GGCCCTGCCCTCCAAATATGTGAACTTCCTGTACCTGGCCAGCCACTATG

AGAAGCTGAAGGGCTCCCCGAGGATAATGAGCAGAAACAGCTGTTTGTG

GAACAGCACAAGCACTACCTGGACGAGATCATCGAGCAGATCAGCGAGTT

CTCCAAGAGAGTGATCCTGGCCGACGCTAATCTGGACAAAGTGCTGTCCG

CCTACAACAAGCACCGGGATAAGCCCATCAGAGAGCAGGCCGAGAATATC

ATCCACCTGTTTACCCTGACCAATCTGGGAGCCCCTGCCGCCTTCAAGTA

CTTTGACACCACCATCGACCGGAAGAGGTACACCAGCACCAAAGAGGTGC

TGGACGCCACCCTGATCCACCAGAGCATCACCGGCCTGTACGAGACACGG

ATCGACCTGTCTCAGCTGGGAGGCGACAGCCCCAAGAAGAAGAGAAAGGT

GGAGGCCAGCTAACATATGATTCGAATGTCTTTCTTGCGCTATGACACTT

CCAGCAAAAGGTAGGGCGGGCTGCGAGACGGCTTCCCGGCGCTGCATGCA

ACACCGATGATGCTTCGACCCCCCGAAGCTCCTTCGGGGCTGCATGGGCG

CTCCGATGCCGCTCCAGGGCGAGCGCTGTTTAAATAGCCAGGCCCCCGAT

TGCAAAGACATTATAGCGAGCTACCAAAGCCATATTCAAACACCTAGATC

ACTACCACTTCTACACAGGCCACTCGAGCTTGTGATCGCACTCCGCTAAG

GGGGCGCCTCTTCCTCTTCGTTTCAGTCACAACCCGCAAACATGACACAA

GAATCCCTGTTACTTCTCGACCGTATTGATTCGGATGATTCCTACGCGAG

CCTGCGAACGACCAGGAATTCTGGGAGGTGAGTCGACGAGCAAGCCCGG

CGGATCAGGCAGCGTGCTTGCAGATTTGACTTGCAACGCCCGCATTGTGT

CGACGAAGGCTTTTGGCTCCTCTGTCGCTGTCTCAAGCAGCATCTAACCC

TGCGTCGCCGTTTCCATTTGCAGCCGCTGGCCCGCCGAGCCCTGGAGGAG

CTCGGGCTGCCGGTGCCGCCGGTGCTGCGGGTGCCCGGCGAGAGCACCAA

CCCCGTACTGGTCGGCGAGCCCGGCCCGGTGATCAAGCTGTTCGGCGAGC

ACTGGTGCGGTCCGGAGAGCCTCGCGTCGGAGTCGGAGGCGTACGCGGTC

CTGGCGGACGCCCCGGTGCCGGTGCCCCGCCTCCTCGGCCGCGGCGAGCT

GCGGCCCGGCACCGGAGCCTGGCCGTGGCCCTACCTGGTGATGAGCCGGA

TGACCGGCACCACCTGGCGGTCCGCGATGGACGGCACGACCGACCGGAAC

GCGCTGCTCGCCCTGGCCCGCGAACTCGGCCGGGTGCTCGGCCGGCTGCA

CAGGGTGCCGCTGACCGGGAACACCGTGCTCACCCCCCATTCCGAGGTCT

TCCCGGAACTGCTGCGGGAACGCCGCGCGGCGACCGTCGAGGACCACCGC

GGGTGGGGCTACCTCTCGCCCCGGCTGCTGGACCGCCTGGAGGACTGGCT

GCCGGACGTGGACACGCTGCTGGCCGGCCGCGAACCCCGGTTCGTCCACG

GCGACCTGCACGGGACCAACATCTTCGTGGACCTGGCCGCGACCGAGGTC

ACCGGGATCGTCGACTTCACCGACGTCTATGCGGGAGACTCCCGCTACAG

CCTGGTGCAACTGCATCTCAACGCCTTCCGGGGCGACCGCGAGATCCTGG

CCGCGCTGCTCGACGGGCGCAGTGGAAGCGGACCGAGGACTTCGCCCGC

GAACTGCTCGCCTTCACCTTCCTGCACGACTTCGAGGTGTTCGAGGAGAC

CCCGCTGGATCTCTCCGGCTTCACCGATCCGGAGGAACTGGCGCAGTTCC

TCTGGGGCCGCCGGACACCGCCCCGGCGCCTGATAAGGATCCGGCAAG

ACTGGCCCCGCTTGGCAACGCAACAGTGAGCCCTCCCTAGTGTGTTTGG

GGATGTGACTATGTATTCGTGTGTTGGCCAACGGGTCAACCCGAACAGAT

TGATACCCGCCTTGGCATTTCCTGTCAGAATGTAACGTCAGTTGATGGTA

CT.
```

For all modified *Chlamydomonas reinhardtii* cells, Applicants use PCR, SURVEYOR nuclease assay, and DNA sequencing to verify successful modification.

Example 8: Crystal Structure

FIGS. 23A-M provide: various views of the CRISPR-cas complex crystal structure (A-I), chemieric RNA architecture from the crystal structure (J-K), an interaction schematic from the crystal structure (L) and a topology schematic from the crystal structure (M).

Figure 23A:
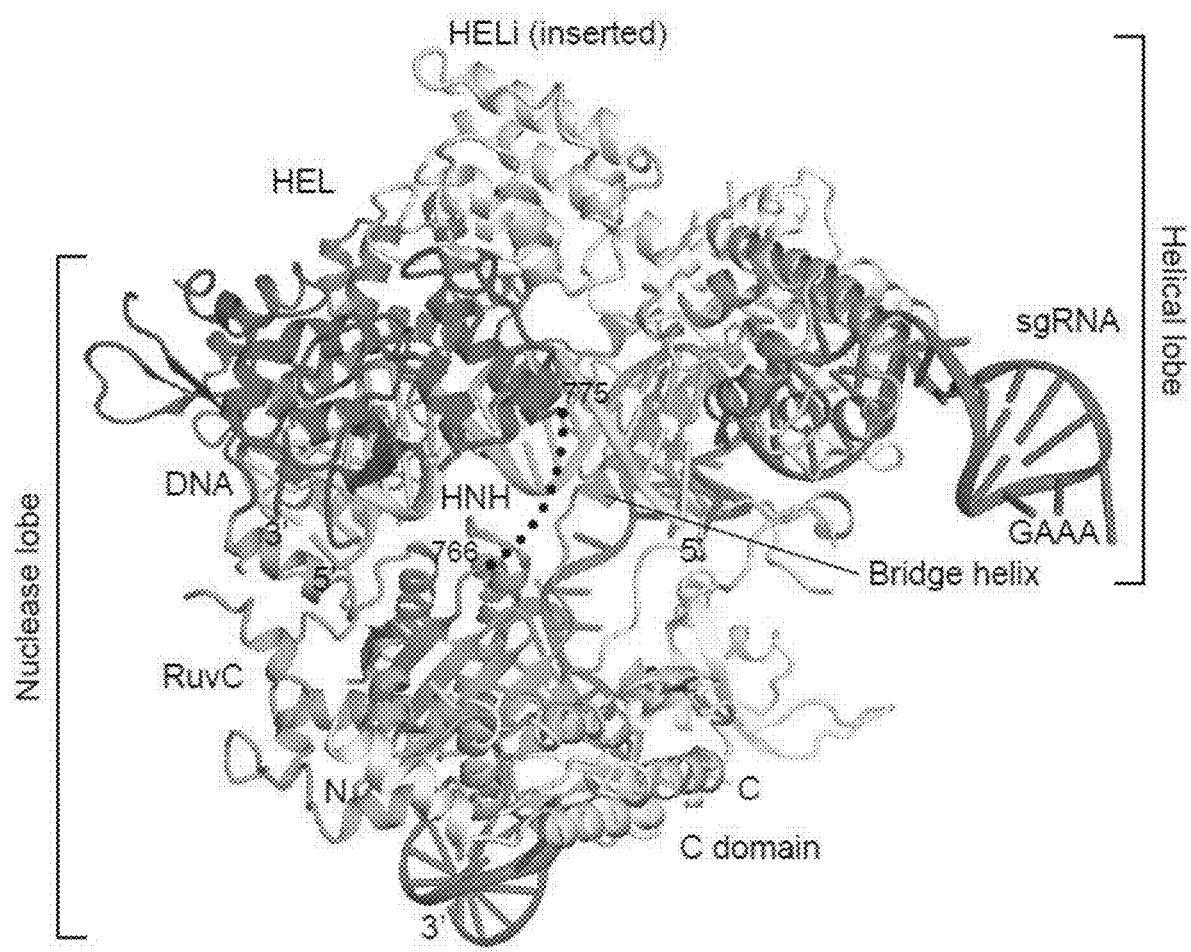
FIGS. 23A-M provide: a diagram showing the topology of the Cas9 protein. Provided is a ribbon representation and various views of the CRISPR-cas complex crystal structure (A-I), chimeric RNA architecture from the crystal structure (J-K), an interaction schematic from the crystal structure (L) and a topology schematic from the crystal structure (M).
Figure 23B:
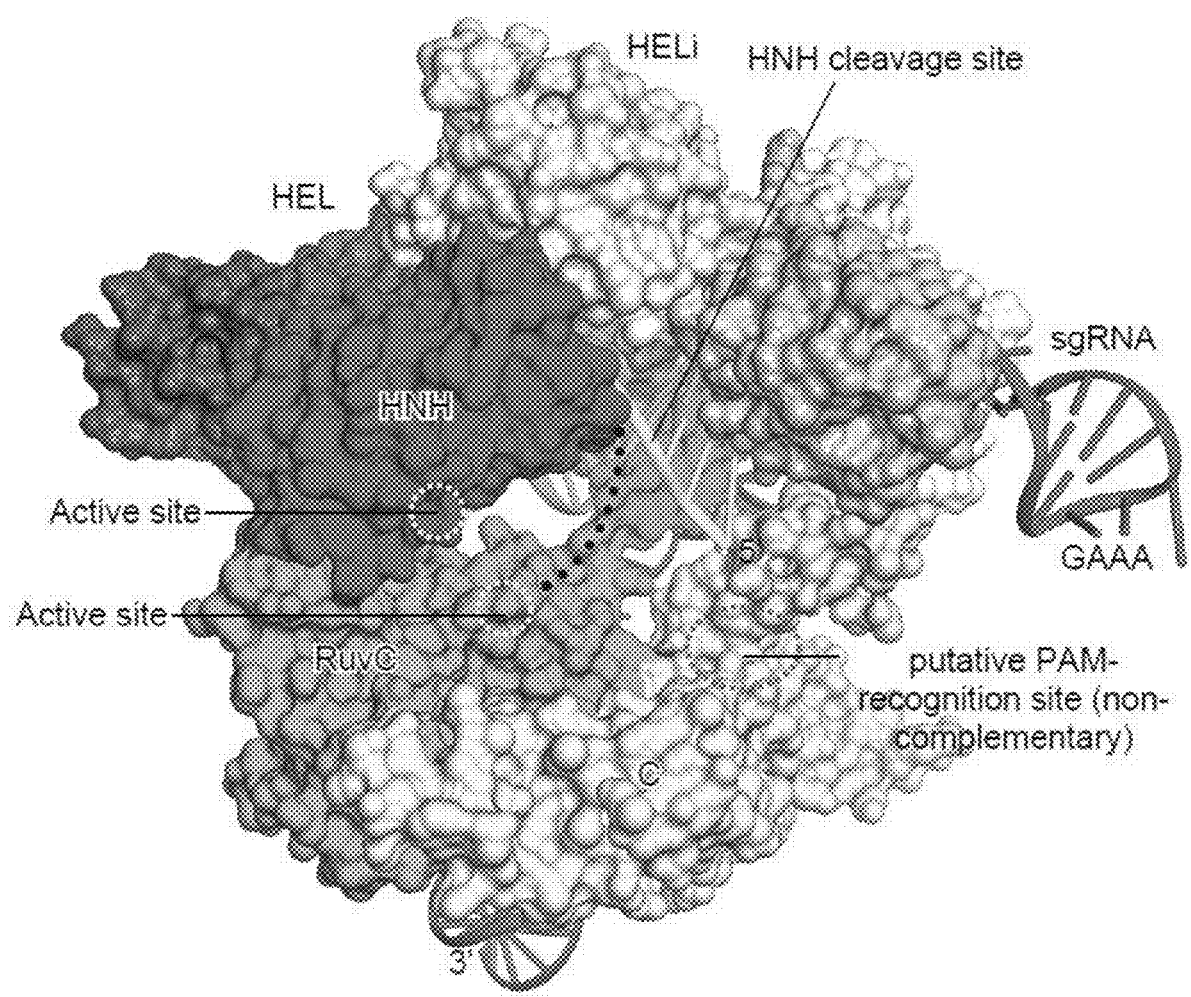
Figure 23C:
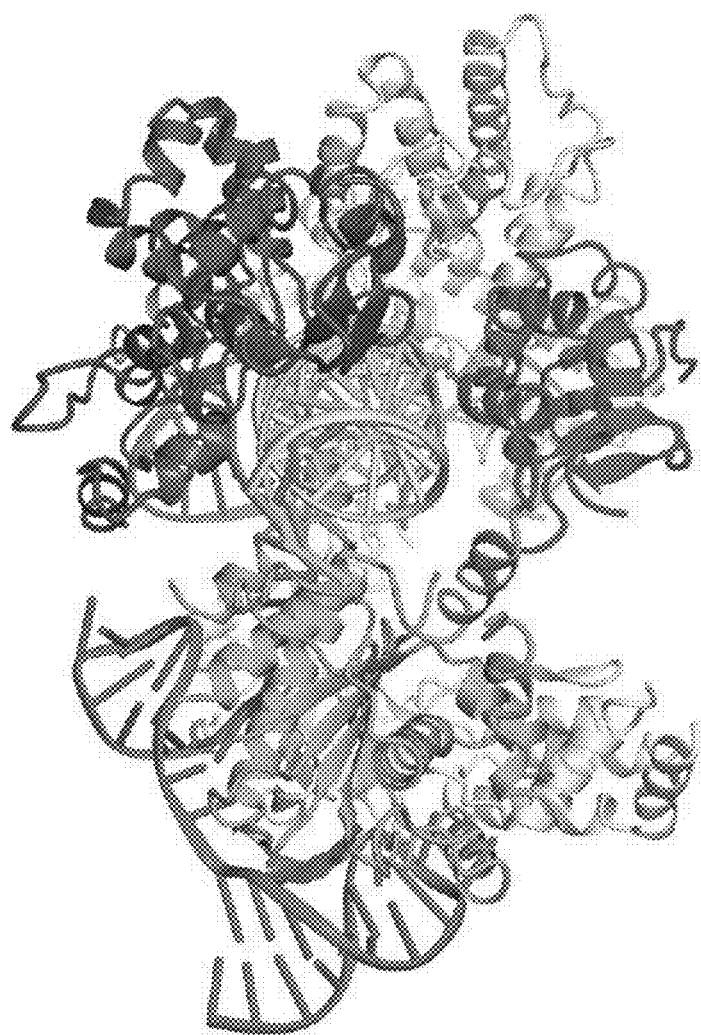
Figure 23D:
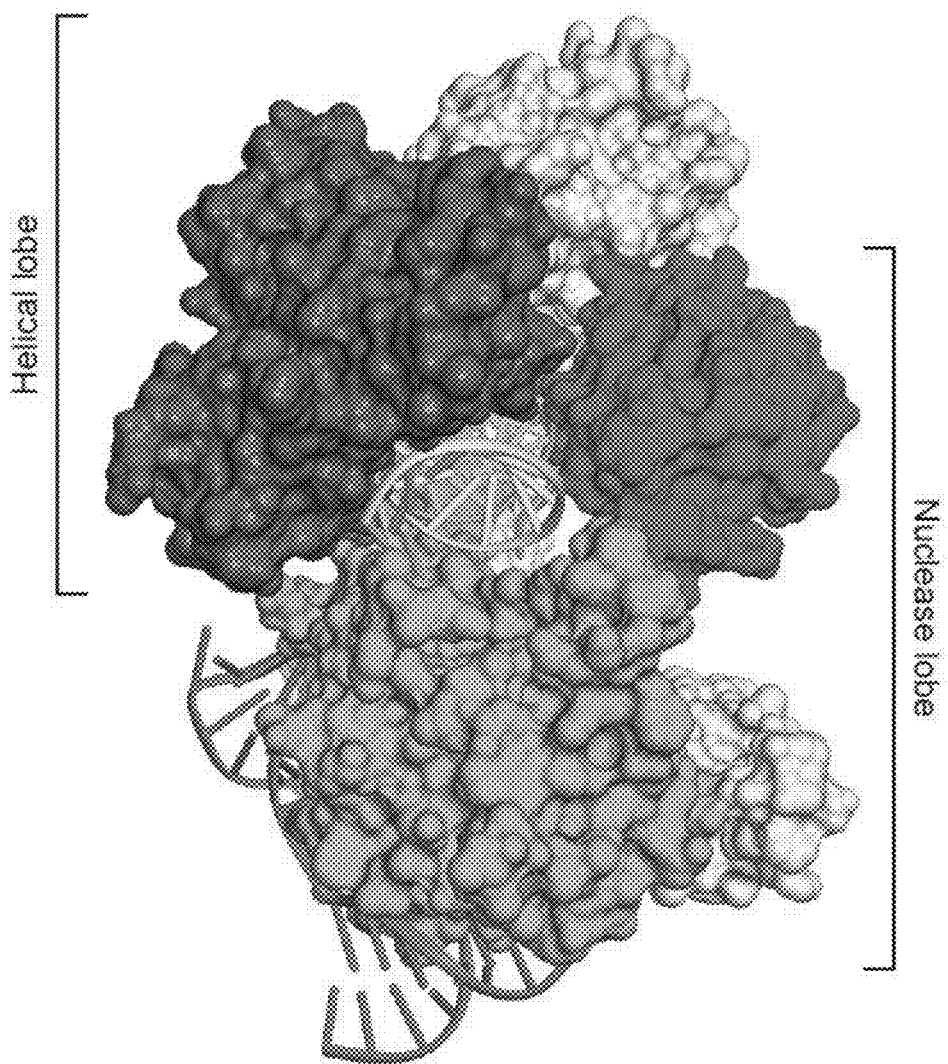
Figure 23E:
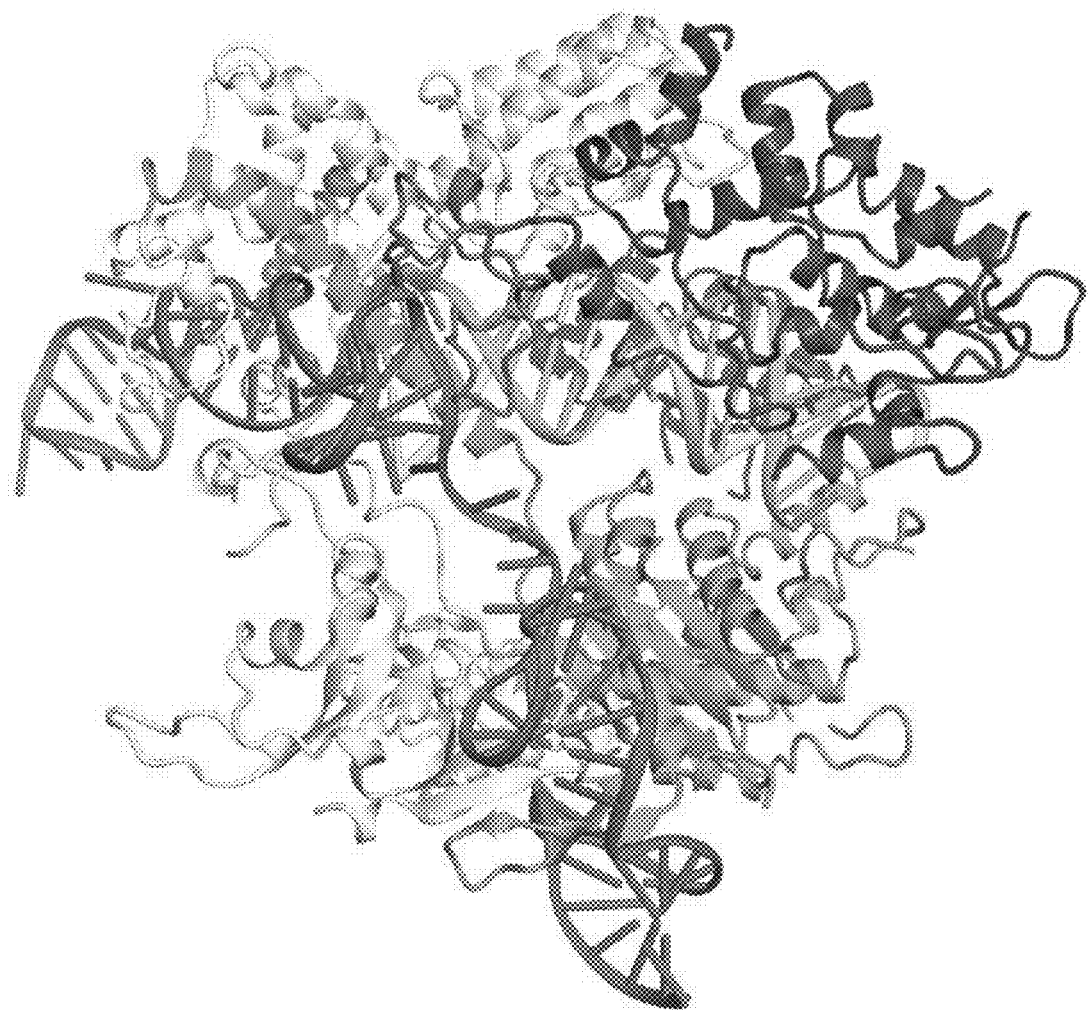
Figure 23F:
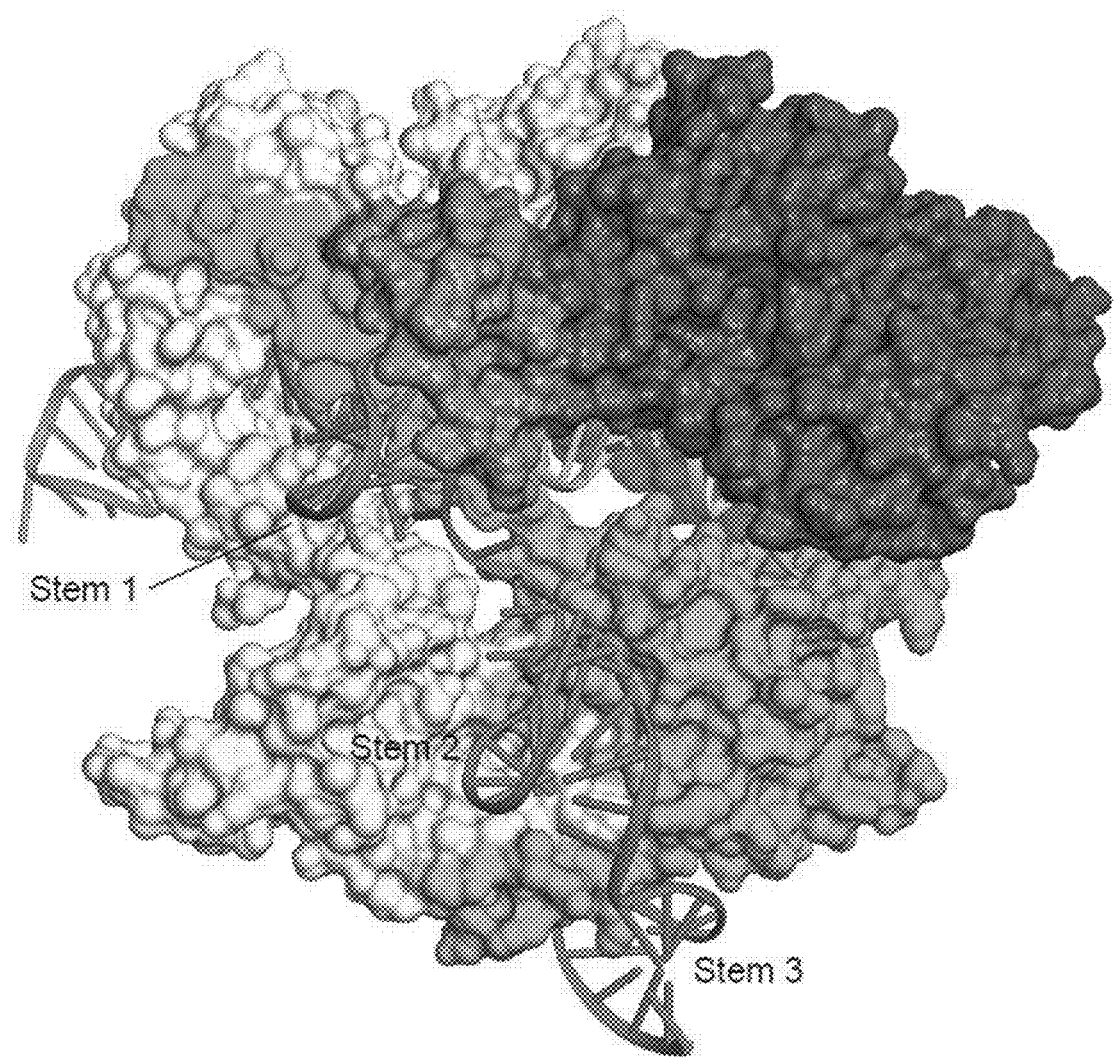
Figure 23G:
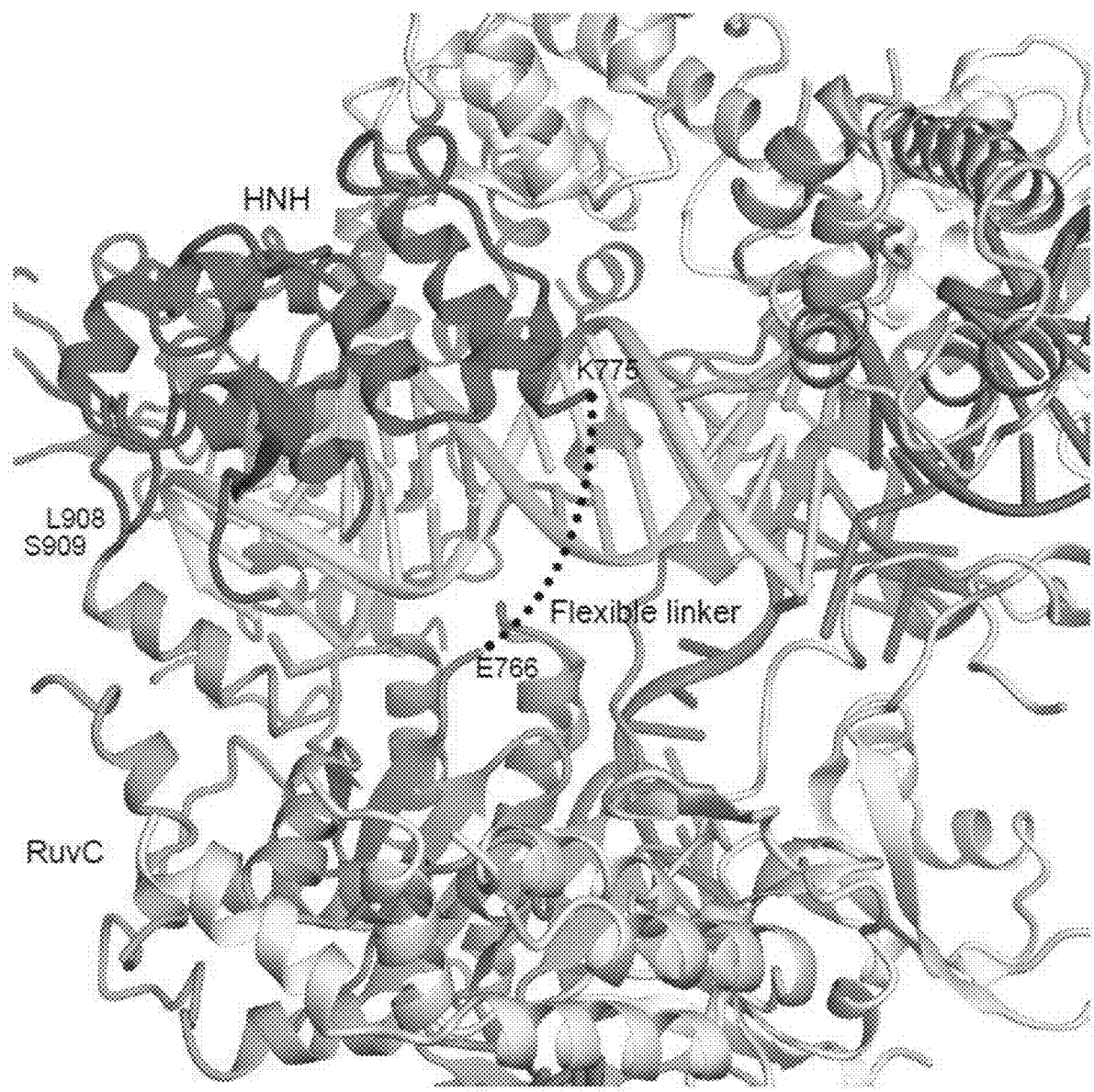
Figure 23H:
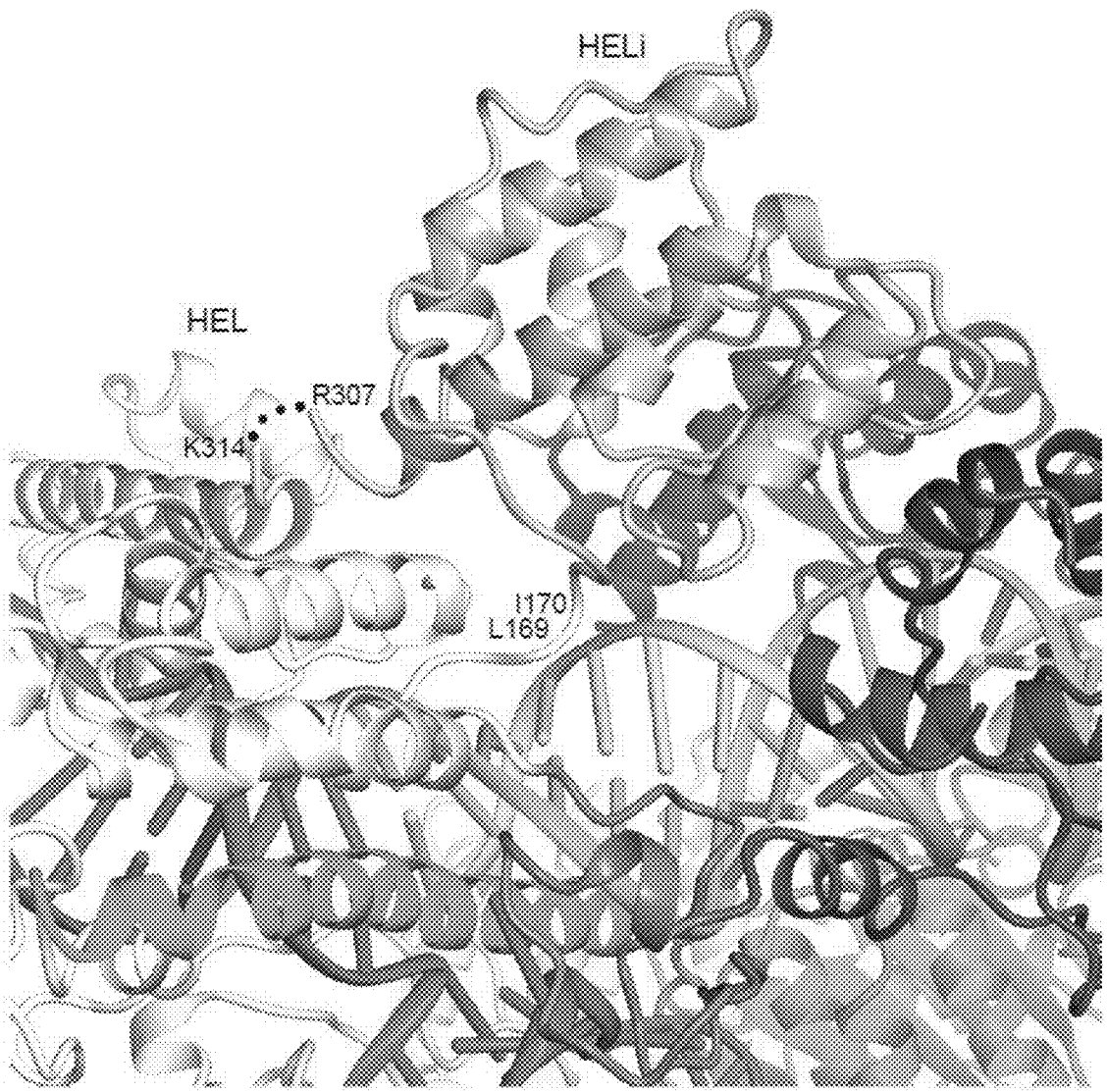
Figure 23I:
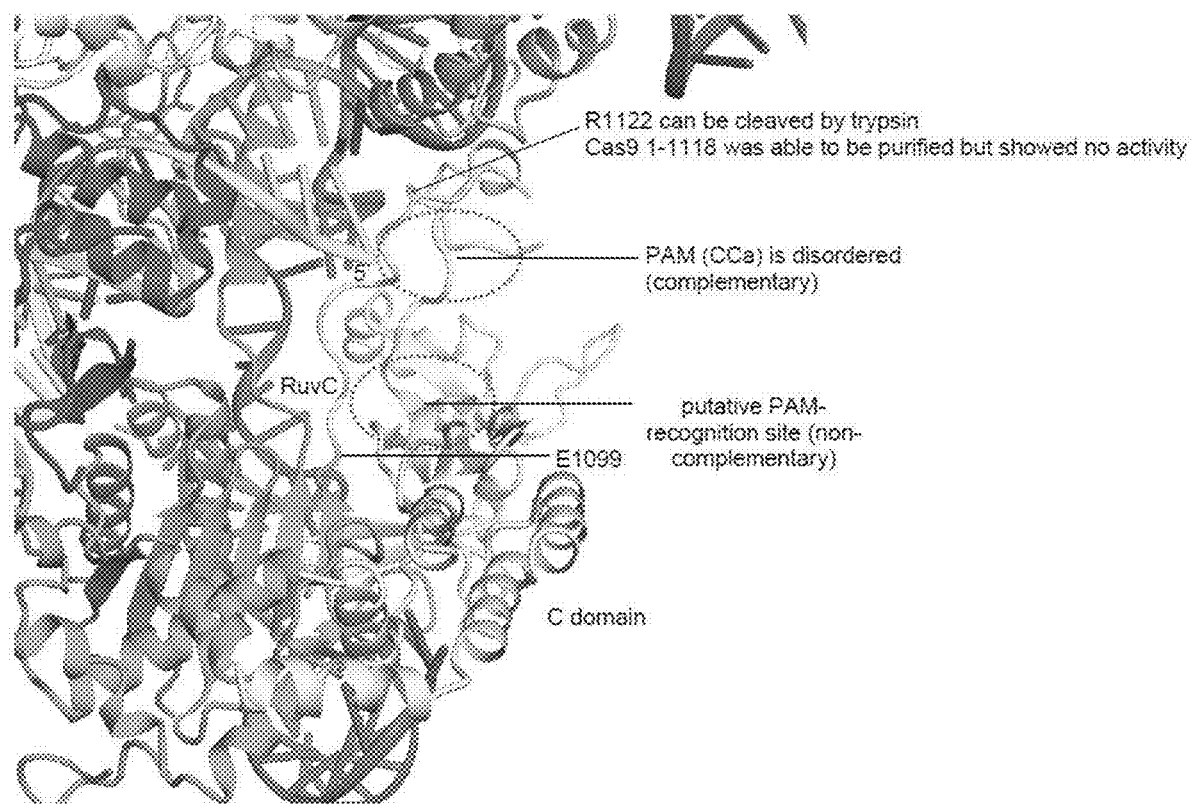
Figure 23J:
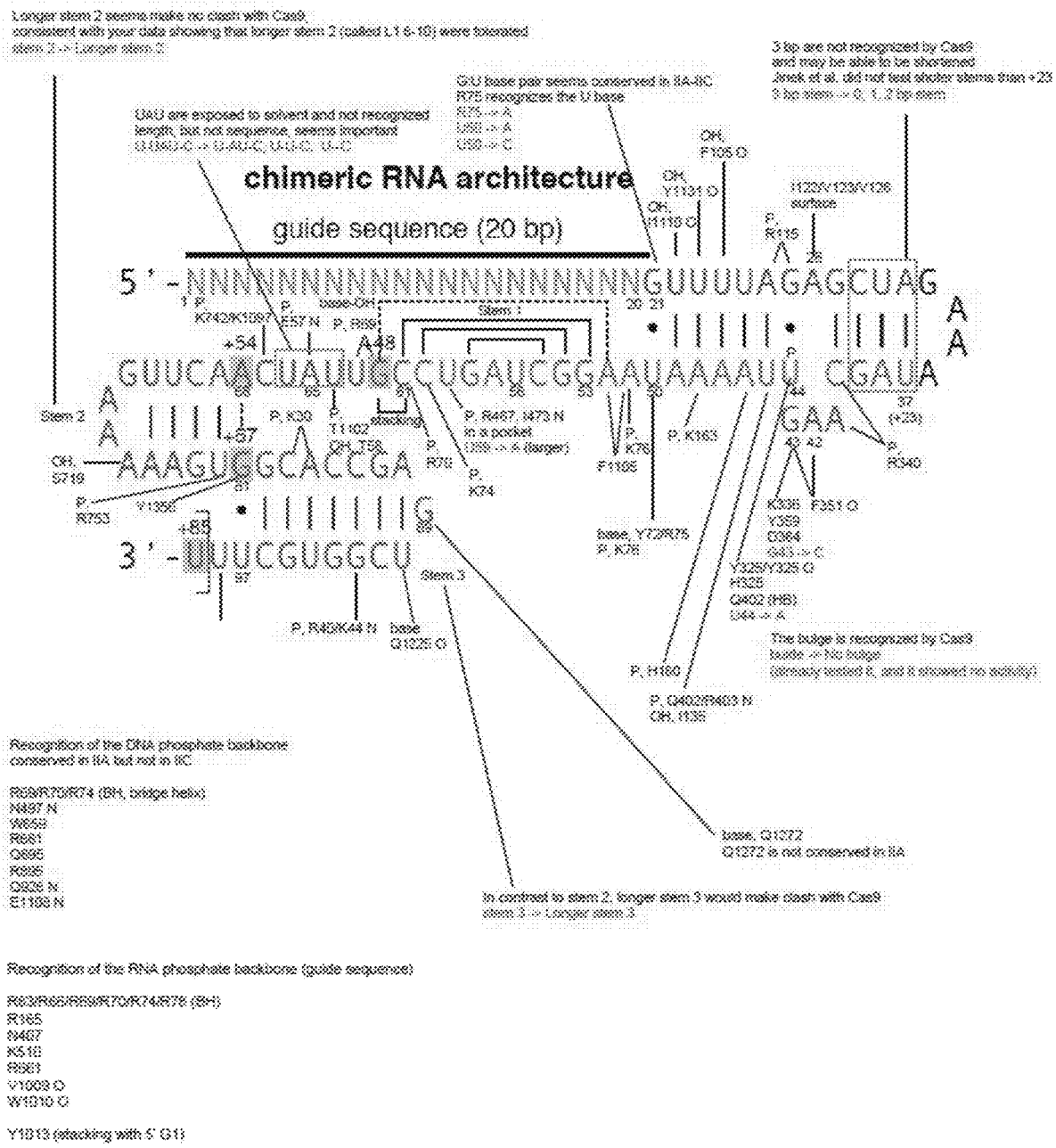
Figure 23K:
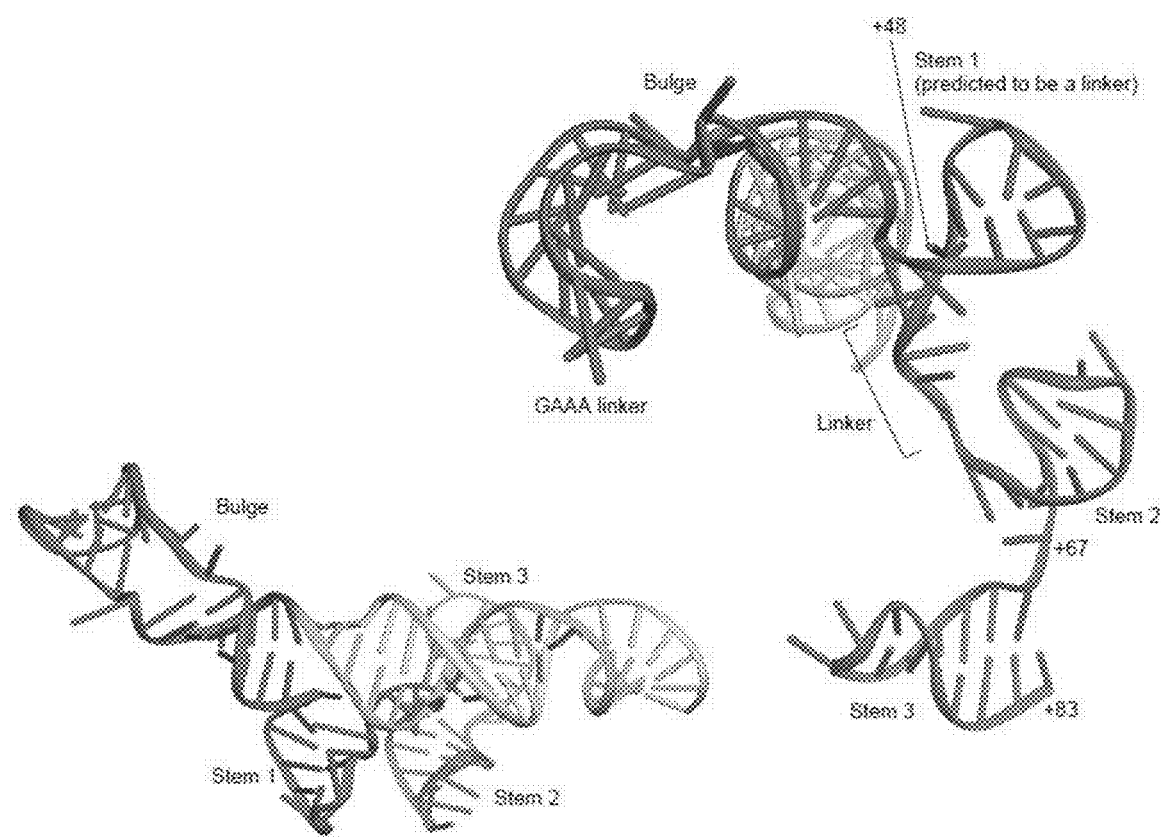
Figure 23L:
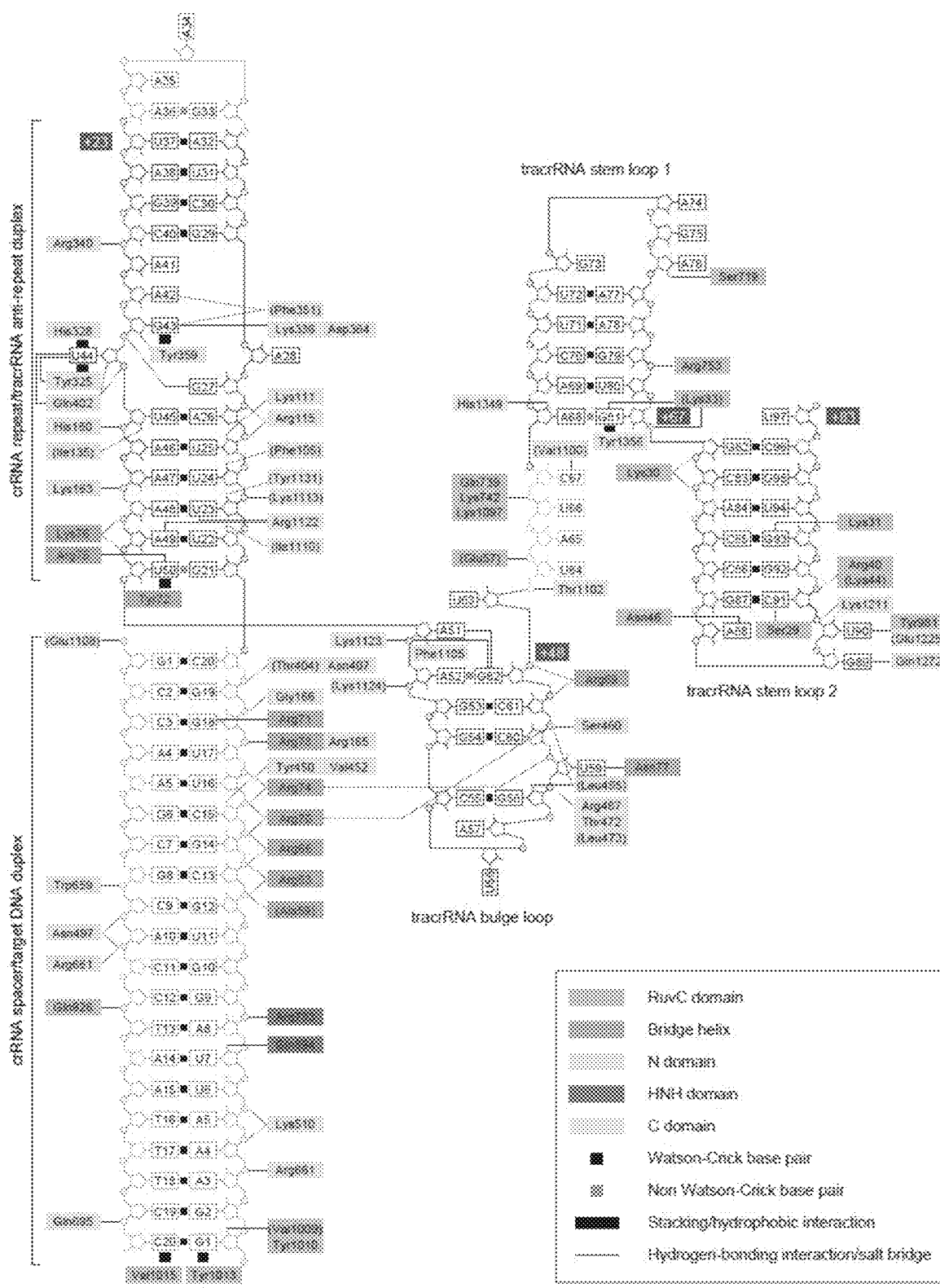
Figure 23M:
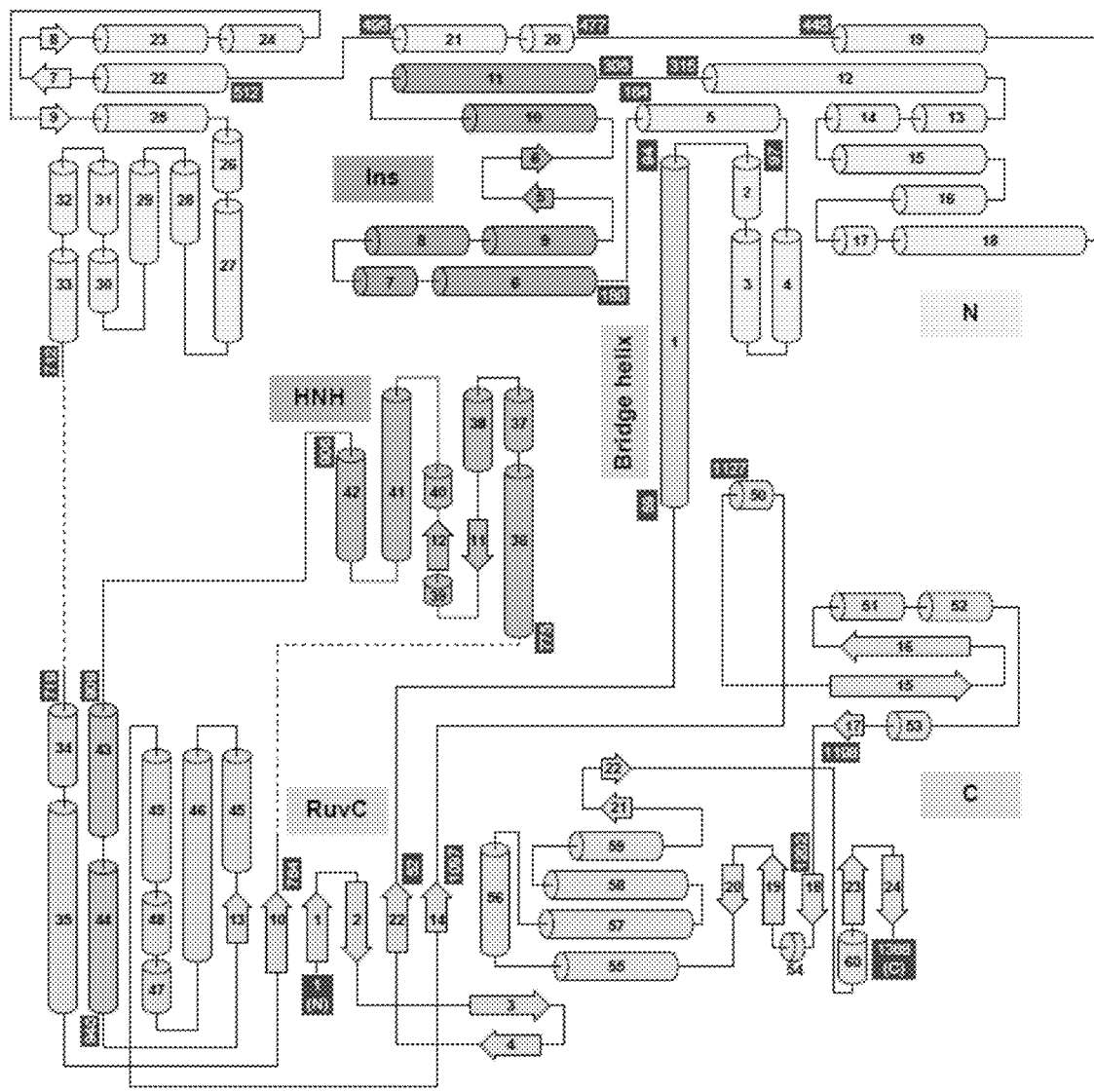

FIGS. 23J-K concern a SpCas9 sgRNA structural study, and FIGS. 26A-B also pertain to sgRNA mutations. SpCas9 sgRNAs were mutated to investigate contribution of specific bases or groups of bases to activity. These include mutations in the direct repeat (DR) and tracrRNA regions of the sgRNA, divided into: stem 1 (base-pairing region between DR and tracrRNA), bulge (un-paired bases between DR and tracrRNA), loop 1 (artificial GAAA connector between DR and tracrRNA), linker 1 (between stem 1 and stem 2), stem 2 (first hairpin formed by tracrRNA tail), loop 2 (loop in between stem 2), stem 3 (second, or last hairpin formed by tracrRNA tail), and loop 3 (loop in between stem 3). Mutations were chosen based on predicted secondary structure as well as secondary structure as illustrated in FIGS. 23A-M, especially FIG. 23J. In addition, three (3) sgRNA scaffolds were designed to incorporate MS2 loops in loop regions for interaction/binding to recruit functional domains fused to MBP. sgRNAs were synthesized as U6::PCR amplicon and tested in co-transfection with wildtype SpCas9.

400 ng of Cas9 plasmid, 100 ng of sgRNA into 200,000 HEK 293FT cells with Lipofectamine 2000; DNA was harvested 3 days post-transfection for SURVEYOR analysis.

The invention thus comprehends the invention comprehends a CRISPR-cas9 (*S. pyogenes*) system having a crystal having the structure defined by the co-ordinates of following Cystral Structure Table (the CRISPR-cas9 crystal structure) (SEQ ID NOS 51-73, respectively, in order of appearance).

Lengthy table referenced here

US10550372-20200204-T00001

Please refer to the end of the specification for access instructions.

Example 9: *S. pyogenes* (Sp) SpCas9 Truncations from Crystal Structure

FIGS. 25A-B pertain to SpCas9 truncations from full length SpCas9. These figures show Surveyor gel test results of SpCas9 truncation mutants from the crystal structure that retain cleavage activity (A) and a table showing the amino acid truncations and flexible (GGGS) (SEQ ID NO: 1) or rigid (A(EAAAK)) (SEQ ID NO: 7) linker substitutions of the lanes of the gels of FIG. 25A (B)

In this Example, SpCas9 sequences were analyzed by 1. Comparing against orthologs (*S. aureus, S. thermophilus* CRISPR1, *S. thermophilus* CRISPR3, and *N. meningiditis*), including smaller Cas9s (*S. aureus, S. thermophilus*

CRISPR1, and *N. meningiditis*) for regions that are conserved or variable, and 2. Boundaries identified by crystallography as being potentially non-critical for contacting target DNA: sgRNA duplex. A region of SpCas9 (helical domain 2) was not present in many smaller Cas9 orthologs, and predicted to be dispensable for function. Two similar sets of truncations were made, one by sequence alignment with smaller Cas9s, one by crystal prediction. In addition, several sets of flexible glycine-serine (GlyGlyGlySer) (SEQ ID NO: 1) or rigid alpha-helical linkers (Ala(GluAlaAlaAla-Lys)Ala) (SEQ ID NO: 2) in groups of 3, 6, 9, or 12 repeats (SEQ ID NOS 3-6, respectively) were also used to replace helical domain 2 for potential structural stabilization and/or aiding of retaining SpCas9:sgRNA specificity. All of the helical region 2 truncations and linker substitutions retained SpCas9 activity. SpCas9 was truncated systematically in Helical 1, 2, and 3 domains, as well as the C'-terminal putative PAM-recognizing domain. Truncation mutants were transfected into HEK 293FT cells as follows: 400 ng of truncation Cas9 plasmid and 100 ng of sgRNA co-transfected into 200,000 cells by Lipofectamine 2000. DNAs from cells were harvested for SURVEYOR analysis.

Below: full length SpCas9 DNA sequence and sequences of the subdomains; followed by helical domain 2 truncation and variants.

>Full length NLS-SpCas9-NLS

```
>Full length NLS-SpCas9-NLS
                                               (SEQ ID NO: 74)
ATGGCCCCAAAGAAGAAGCGGAAGGTCGGTATCCACGGAGTCCCAGCAGC

CGACAAGAAGTACAGCATCGGCCTGGACATCGGCACCAACTCTGTGGGCT

GGGCCGTGATCACCGACGAGTACAAGGTGCCCAGCAAGAAATTCAAGGTG

CTGGGCAACACCGACCGGCACAGCATCAAGAAGAACCTGATCGGAGCCCT

GCTGTTCGACAGCGGCGAAACAGCCGAGGCCACCCGGCTGAAGAGAACCG

CCAGAAGAAGATACACCAGACGGAAGAACCGGATCTGCTATCTGCAAGAG

ATCTTCAGCAACGAGATGGCCAAGGTGGACGACAGCTTCTTCCACAGACT

GGAAGAGTCCTTCCTGGTGGAAGAGGATAAGAAGCACGAGCGGCACCCCA

TCTTCGGCAACATCGTGGACGAGGTGGCCTACCACGAGAAGTACCCCACC

ATCTACCACCTGAGAAAGAAACTGGTGGACAGCACCGACAAGGCCGACCT

GCGGCTGATCTATCTGGCCCTGGCCCACATGATCAAGTTCCGGGGCCACT

TCCTGATCGAGGGCGACCTGAACCCCGACAACAGCGACGTGGACAAGCTG

TTCATCCAGCTGGTGCAGACCTACAACCAGCTGTTCGAGGAAAACCCCAT

CAACGCCAGCGGCGTGGACGCCAAGGCCATCCTGTCTGCCAGACTGAGCA

AGAGCAGACGGCTGGAAAATCTGATCGCCCAGCTGCCCGGCGAGAAGAAG

AATGGCCTGTTCGGAAACCTGATTGCCCTGAGCCTGGGCCTGACCCCCAA

CTTCAAGAGCAACTTCGACCTGGCCGAGGATGCCAAACTGCAGCTGAGCA

AGGACACCTACGACGACGACCTGGACAACCTGCTGGCCCAGATCGGCGAC

CAGTACGCCGACCTGTTTCTGGCCGCCAAGAACCTGTCCGACGCCATCCT

GCTGAGCGACATCCTGAGAGTGAACACCGAGATCACCAAGGCCCCCCTGA

GCGCCTCTATGATCAAGAGATACGACGAGCACCACCAGGACCTGACCCTG

CTGAAAGCTCTCGTGCGGCAGCAGCTGCCTGAGAAGTACAAAGAGATTTT

CTTCGACCAGAGCAAGAACGGCTACGCCGGCTACATTGACGGCGGAGCCA

GCCAGGAAGAGTTCTACAAGTTCATCAAGCCCATCCTGGAAAAGATGGAC

GGCACCGAGGAACTGCTCGTGAAGCTGAACAGAGAGGACCTGCTGCGGAA

GCAGCGGACCTTCGACAACGGCAGCATCCCCCACCAGATCCACCTGGGAG

AGCTGCACGCCATTCTGCGGCGGCAGGAAGATTTTTACCCATTCCTGAAG

GACAACCGGGAAAAGATCGAGAAGATCCTGACCTTCCGCATCCCCTACTA

CGTGGGCCCTCTGGCCAGGGGAAACAGCAGATTCGCCTGGATGACCAGAA

AGAGCGAGGAAACCATCACCCCCTGGAACTTCGAGGAAGTGGTGGACAAG

GGCGCTTCCGCCCAGAGCTTCATCGAGCGGATGACCAACTTCGATAAGAA

CCTGCCCAACGAGAAGGTGCTGCCCAAGCACAGCCTGCTGTACGAGTACT

TCACCGTGTATAACGAGCTGACCAAAGTGAAATACGTGACCGAGGGAATG

AGAAAGCCCGCCTTCCTGAGCGGCGAGCAGAAAAAGGCCATCGTGGACCT

GCTGTTCAAGACCAACCGGAAAGTGACCGTGAAGCAGCTGAAAGAGGACT

ACTTCAAGAAAATCGAGTGCTTCGACTCCGTGGAAATCTCCGGCGTGGAA

GATCGGTTCAACGCCTCCCTGGGCACATACCACGATCTGCTGAAAATTAT

CAAGGACAAGGACTTCCTGGACAATGAGGAAAACGAGGACATTCTGGAAG

ATATCGTGCTGACCCTGACACTGTTTGAGGACAGAGAGATGATCGAGGAA

CGGCTGAAAACCTATGCCCACCTGTTCGACGACAAAGTGATGAAGCAGCT

GAAGCGGCGGAGATACACCGGCTGGGGCAGGCTGAGCCGGAAGCTGATCA

ACGGCATCCGGGACAAGCAGTCCGGCAAGACAATCCTGGATTTCCTGAAG

TCCGACGGCTTCGCCAACAGAAACTTCATGCAGCTGATCCACGACGACAG

CCTGACCTTTAAAGAGGACATCCAGAAAGCCCAGGTGTCCGGCCAGGGCG

ATAGCCTGCACGAGCACATTGCCAATCTGGCCGGCAGCCCCGCCATTAAG

AAGGGCATCCTGCAGACAGTGAAGGTGGTGGACGAGCTCGTGAAAGTGAT

GGGCCGGCACAAGCCCGAGAACATCGTGATCGAAATGGCCAGAGAGAACC

AGACCACCCAGAAGGGACAGAAGAACAGCCGCGAGAGAATGAAGCGGATC

GAAGAGGGCATCAAAGAGCTGGGCAGCCAGATCCTGAAAGAACACCCCGT

GGAAAACACCCAGCTGCAGAACGAGAAGCTGTACCTGTACTACCTGCAGA

ATGGGCGGGATATGTACGTGGACCAGGAACTGGACATCAACCGGCTGTCC

GACTACGATGTGGACCATATCGTGCCTCAGAGCTTTCTGAAGGACGACTC

CATCGACAACAAGGTGCTGACCAGAAGCGACAAGAACCGGGGCAAGAGCG

ACAACGTGCCCTCCGAAGAGGTCGTGAAGAAGATGAAGAACTACTGGCGG

CAGCTGCTGAACGCCAAGCTGATTACCCAGAGAAAGTTCGACAATCTGAC

CAAGGCCGAGAGAGGCGGCCTGAGCGAACTGGATAAGGCCGGCTTCATCA

AGAGACAGCTGGTGGAAACCCGGCAGATCACAAAGCACGTGGCACAGATC

CTGGACTCCCGGATGAACACTAAGTACGACGAGAATGACAAGCTGATCCG

GGAAGTGAAAGTGATCACCCTGAAGTCCAAGCTGGTGTCCGATTTCCGGA

AGGATTTCCAGTTTTACAAAGTGCGCGAGATCAACAACTACCACCACGCC

CACGACGCCTACCTGAACGCCGTCGTGGGAACCGCCCTGATCAAAAAGTA

CCCTAAGCTGGAAAGCGAGTTCGTGTACGGCGACTACAAGGTGTACGACG

TGCGGAAGATGATCGCCAAGAGCGAGCAGGAAATCGGCAAGGCTACCGCC
```

```
AAGTACTTCTTCTACAGCAACATCATGAACTTTTTCAAGACCGAGATTAC

CCTGGCCAACGGCGAGATCCGGAAGCGGCCTCTGATCGAGACAAACGGCG

AAACCGGGGAGATCGTGTGGGATAAGGGCCGGGATTTTGCCACCGTGCGG

AAAGTGCTGAGCATGCCCCAAGTGAATATCGTGAAAAAGACCGAGGTGCA

GACAGGCGGCTTCAGCAAAGAGTCTATCCTGCCCAAGAGGAACAGCGATA

AGCTGATCGCCAGAAAGAAGGACTGGGACCCTAAGAAGTACGGCGGCTTC

GACAGCCCCACCGTGGCCTATTCTGTGCTGGTGGTGGCCAAAGTGGAAAA

GGGCAAGTCCAAGAAACTGAAGAGTGTGAAAGAGCTGCTGGGGATCACCA

TCATGGAAGAAGCAGCTTCGAGAAGAATCCCATCGACTTTCTGGAAGCC

AAGGGCTACAAAGAAGTGAAAAAGGACCTGATCATCAAGCTGCCTAAGTA

CTCCCTGTTCGAGCTGGAAAACGGCCGGAAGAGAATGCTGGCCTCTGCCG

GCGAACTGCAGAAGGGAAACGAACTGGCCCTGCCCTCCAAATATGTGAAC

TTCCTGTACCTGGCCAGCCACTATGAGAAGCTGAAGGGCTCCCCCGAGGA

TAATGAGCAGAAACAGCTGTTTGTGGAACAGCACAAGCACTACCTGGACG

AGATCATCGAGCAGATCAGCGAGTTCTCCAAGAGAGTGATCCTGGCCGAC

GCTAATCTGGACAAAGTGCTGTCCGCCTACAACAAGCACGGGATAAGCC

CATCAGAGAGCAGGCCGAGAATATCATCCACCTGTTTACCCTGACCAATC

TGGGAGCCCCTGCCGCCTTCAAGTACTTTGACACCACCATCGACCGGAAG

AGGTACACCAGCACCAAAGAGGTGCTGGACGCCACCCTGATCCACCAGAG

CATCACCGGCCTGTACGAGACACGGATCGACCTGTCTCAGCTGGGAGGCG

ACAAAAGGCCGGCGGCCACGAAAAAGGCCGGCCAGGCAAAAAAGAAAAAG taa

>N'-terminal NLS
                                        (SEQ ID NO: 75)
ATGGCCCCAAAGAAGAAGCGGAAGGTCGGTATCCACGGAGTCCCAGCAG

CC

>RuvCI domain
                                        (SEQ ID NO: 76)
GACAAGAAGTACAGCATCGGCCTGGACATCGGCACCAACTCTGTGGGCTG

GGCCGTGATCACCGACGAGTACAAGGTGCCCAGCAAGAAATTCAAGGTGC

TGGGCAACACCGACCGGCACAGCATCAAGAAGAACCTGATCGGAGCCCTG

CTGTTCGACAGCGGCGAAACA

>Bridging helix
                                        (SEQ ID NO: 77)
GCCGAGGCCACCCGGCTGAAGAGAACCGCCAGAAGAAGATACACCAGACG

GAAGAACCGGATCTGCTATCTGCAAGAGATCTTC

>Helical domain 1
                                        (SEQ ID NO: 78)
AGCAACGAGATGGCCAAGGTGGACGACAGCTTCTTCCACAGACTGGAAGA

GTCCTTCCTGGTGGAAGAGGATAAGAAGCACGAGCGGCACCCCATCTTCG

GCAACATCGTGGACGAGGTGGCCTACCACGAGAAGTACCCCACCATCTAC

CACCTGAGAAAGAAACTGGTGGACAGCACCGACAAGGCCGACCTGCGGCT

GATCTATCTGGCCCTGGCCCACATGATCAAGTTCCGGGGCCACTTCCTGA

TCGAGGGCGAC

>Helical domain 2 (dispensable)
                                        (SEQ ID NO: 79)
CTGAACCCCGACAACAGCGACGTGGACAAGCTGTTCATCCAGCTGGTGCA

GACCTACAACCAGCTGTTCGAGGAAAACCCCATCAACGCCAGCGGCGTGG

ACGCCAAGGCCATCCTGTCTGCCAGACTGAGCAAGAGCAGACGGCTGGAA

AATCTGATCGCCCAGCTGCCCGGCGAGAAGAAGAATGGCCTGTTCGGAAA

CCTGATTGCCCTGAGCCTGGGCCTGACCCCCAACTTCAAGAGCAACTTCG

ACCTGGCCGAGGATGCCAAACTGCAGCTGAGCAAGGACACCTACGACGAC

GACCTGGACAACCTGCTGGCCCAGATCGGCGACCAGTACGCCGACCTGTT

TCTGGCCGCCAAGAACCTGTCCGACGCCATCCTGCTGAGCGACATCCTGA

GAGTGAACACCGAG

>Helical domain 3
                                        (SEQ ID NO: 80)
ATCACCAAGGCCCCCCTGAGCGCCTCTATGATCAAGAGATACGACGAGCA

CCACCAGGACCTGACCCTGCTGAAAGCTCTCGTGCGGCAGCAGCTGCCTG

AGAAGTACAAAGAGATTTTCTTCGACCAGAGCAAGAACGGCTACGCCGGC

TACATTGACGGCGGAGCCAGCCAGGAAGAGTTCTACAAGTTCATCAAGCC

CATCCTGGAAAAGATGGACGGCACCGAGGAACTGCTCGTGAAGCTGAACA

GAGAGGACCTGCTGCGGAAGCAGCGGACCTTCGACAACGGCAGCATCCCC

CACCAGATCCACCTGGGAGAGCTGCACGCCATTCTGCGGCGGCAGGAAGA

TTTTTACCCATTCCTGAAGGACAACCGGGAAAAGATCGAGAAGATCCTGA

CCTTCCGCATCCCCTACTACGTGGGCCCTCTGGCCAGGGGAAACAGCAGA

TTCGCCTGGATGACCAGAAAGAGCGAGGAAACCATCACCCCCTGGAACTT

CGAGGAAGTGGTGGACAAGGGCGCTTCCGCCCAGAGCTTCATCGAGCGGA

TGACCAACTTCGATAAGAACCTGCCCAACGAGAAGGTGCTGCCCAAGCAC

AGCCTGCTGTACGAGTACTTCACCGTGTATAACGAGCTGACCAAAGTGAA

ATACGTGACCGAGGGAATGAGAAAGCCCGCCTTCCTGAGCGGCGAGCAGA

AAAAGGCCATCGTGGACCTGCTGTTCAAGACCAACCGGAAAGTGACCGTG

AAGCAGCTGAAAGAGGACTACTTCAAGAAAATCGAGTGCTTCGACTCCGT

GGAAATCTCCGGCGTGGAAGATCGGTTCAACGCCTCCCTGGGCACATACC

ACGATCTGCTGAAAATTATCAAGGACAAGGACTTCCTGGACAATGAGGAA

AACGAGGACATTCTGGAAGATATCGTGCTGACCCTGACACTGTTTGAGGA

CAGAGAGATGATCGAGGAACGGCTGAAAACCTATGCCCACCTGTTCGACG

ACAAAGTGATGAAGCAGCTGAAGCGGCGGAGATACACCGGCTGGGGCAGG

CTGAGCCGGAAGCTGATCAACGGCATCCGGGACAAGCAGTCCGGCAAGAC

AATCCTGGATTTCCTGAAGTCCGACGGCTTCGCCAACAGAAACTTCATGC

AGCTGATCCACGACGACAGCCTGACCTTTAAAGAGGACATCCAGAAAGCC

>Flexible linker
                                        (SEQ ID NO: 81)
CAGGTGTCCGGCCAGGGCGAT >RuvC II
                                        (SEQ ID NO: 82)
ATCGTGATCGAAATGGCCAGAGAG
```

>HNH (SEQ ID NO: 83)

GACTACGATGTGGACCATATCGTGCCTCAGAGCTTTCTGAAGGACGACTC

CATCGACAACAAGGTGCTGACCAGAAGCGACAAGAAC

>RuvCIII (SEQ ID NO: 84)

CACCACGCCCACGACGCCTACCTG

>C-terminal (PAM recognizing domain)

(SEQ ID NO: 85)

ACCGAGGTGCAGACAGGCGGCTTCAGCAAAGAGTCTATCCTGCCCAAGAG

GAACAGCGATAAGCTGATCGCCAGAAAGAAGGACTGGGACCCTAAGAAGT

ACGGCGGCTTCGACAGCCCCACCGTGGCCTATTCTGTGCTGGTGGTGGCC

AAAGTGGAAAAGGGCAAGTCCAAGAAACTGAAGAGTGTGAAAGAGCTGCT

GGGGATCACCATCATGGAAAGAAGCAGCTTCGAGAAGAATCCCATCGACT

TTCTGGAAGCCAAGGGCTACAAAGAAGTGAAAAAGGACCTGATCATCAAG

CTGCCTAAGTACTCCCTGTTCGAGCTGGAAAACGGCCGGAAGAGAATGCT

GGCCTCTGCCGGCGAACTGCAGAAGGGAAACGAACTGGCCCTGCCCTCCA

AATATGTGAACTTCCTGTACCTGGCCAGCCACTATGAGAAGCTGAAGGGC

TCCCCCGAGGATAATGAGCAGAAACAGCTGTTTGTGGAACAGCACAAGCA

CTACCTGGACGAGATCATCGAGCAGATCAGCGAGTTCTCCAAGAGAGTGA

TCCTGGCCGACGCTAATCTGGACAAAGTGCTGTCCGCCTACAACAAGCAC

CGGGATAAGCCCATCAGAGAGCAGGCCGAGAATATCATCCACCTGTTTAC

CCTGACCAATCTGGGAGCCCCTGCCGCCTTCAAGTACTTTGACACCACCA

TCGACCGGAAGAGGTACACCAGCACCAAAGAGGTGCTGGACGCCACCCTG

ATCCACCAGAGCATCACCGGCCTGTACGAGACACGGATCGACCTGTCTCA

GCTGGGAGGCGAC

C'-NLS (SEQ ID NO: 86)

AAAAGGCCGGCGGCCACGAAAAAGGCCGGCCAGGCAAAAAAGAAAAAG

6. Sp_A_hel 2(174-311)
helical domain 2 deletion (from ortholog alignment)

(SEQ ID NO: 87)

ATGGCCCCAAAGAAGAAGCGGAAGGTCGGTATCCACGGAGTCCCAGCAGC

CGACAAGAAGTACAGCATCGGCCTGGACATCGGCACCAACTCTGTGGGCT

GGGCCGTGATCACCGACGAGTACAAGGTGCCCAGCAAGAAATTCAAGGTG

CTGGGCAACACCGACCGGCACAGCATCAAGAAGAACCTGATCGGAGCCCT

GCTGTTCGACAGCGGCGAAACAGCCGAGGCCACCCGGCTGAAGAGAACCG

CCAGAAGAAGATACACCAGACGGAAGAACCGGATCTGCTATCTGCAAGAG

ATCTTCAGCAACGAGATGGCCAAGGTGGACGACAGCTTCTTCCACAGACT

GGAAGAGTCCTTCCTGGTGGAAGAGGATAAGAAGCACGAGCGGCACCCCA

TCTTCGGCAACATCGTGGACGAGGTGGCCTACCACGAGAAGTACCCCACC

ATCTACCACCTGAGAAAGAAACTGGTGGACAGCACCGACAAGGCCGACCT

GCGGCTGATCTATCTGGCCCTGGCCCACATGATCAAGTTCCGGGGCCACT

TCCTGATCGAGGGCGACATCACCAAGGCaCCaCTGAGCGCCTCTATGATC

AAGAGATACGACGAGCACCACCAGGACCTGACCCTGCTGAAAGCTCTCGT

GCGGCAGCAGCTGCCTGAGAAGTACAAAGAGATTTTCTTCGACCAGAGCA

AGAACGGCTACGCCGGCTACATTGACGGCGGAGCCAGCCAGGAAGAGTTC

TACAAGTTCATCAAGCCCATCCTGGAAAAGATGGACGGCACCGAGGAACT

GCTCGTGAAGCTGAACAGAGAGGACCTGCTGCGCAAGCAGCGGACCTTCG

ACAACGGCAGCATCCCCCACCAGATCCACCTGGGAGAGCTGCACGCCATT

CTGCGGCGGCAGGAAGATTTTTACCCATTCCTGAAGGACAACCGGGAAAA

GATCGAGAAGATCCTGACCTTCCGCATCCCCTACTACGTGGGCCCTCTGG

CCAGGGGAAACAGCAGATTCGCCTGGATGACCAGAAAGAGCGAGGAAACC

ATCACCCCCTGGAACTTCGAGGAAGTGGTGGACAAGGGCGCTTCCGCCCA

GAGCTTCATCGAGCGGATGACCAACTTCGATAAGAACCTGCCCAACGAGA

AGGTGCTGCCCAAGCACAGCCTGCTGTACGAGTACTTCACCGTGTATAAC

GAGCTGACCAAAGTGAAATACGTGACCGAGGGAATGAGAAAGCCCGCCTT

CCTGAGCGGCGAGCAGAAAAAGGCCATCGTGGACCTGCTGTTCAAGACCA

ACCGGAAAGTGACCGTGAAGCAGCTGAAAGAGGACTACTTCAAGAAAATC

GAGTGCTTCGACTCCGTGGAAATCTCCGGCGTGGAAGATCGGTTCAACGC

CTCCCTGGGCACATACCACGATCTGCTGAAAATTATCAAGGACAAGGACT

TCCTGGACAATGAGGAAAACGAGGACATTCTGGAAGATATCGTGCTGACC

CTGACACTGTTTGAGGACAGAGAGATGATCGAGGAACGGCTGAAAACCTA

TGCCCACCTGTTCGACGACAAAGTGATGAAGCAGCTGAAGCGGCGGAGAT

ACACCGGCTGGGGCAGGCTGAGCCGGAAGCTGATCAACGGCATCCGGGAC

AAGCAGTCCGGCAAGACAATCCTGGATTTCCTGAAGTCCGACGGCTTCGC

CAACAGAAACTTCATGCAGCTGATCCACGACGACAGCCTGACCTTTAAAG

AGGACATCCAGAAAGCCCAGGTGTCCGGCCAGGGCGATAGCCTGCACGAG

CACATTGCCAATCTGGCCGGCAGCCCCGCCATTAAGAAGGGCATCCTGCA

GACAGTGAAGGTGGTGGACGAGCTCGTGAAAGTGATGGGCCGGCACAAGC

CCGAGAACATCGTGATCGAAATGGCCAGAGAGAACCAGACCACCCAGAAG

GGACAGAAGAACAGCCGCGAGAGAATGAAGCGGATCGAAGAGGGCATCAA

AGAGCTGGGCAGCCAGATCCTGAAAGAACACCCCGTGGAAAACACCCAGC

TGCAGAACGAGAAGCTGTACCTGTACTACCTGCAGAATGGGCGGGATATG

TACGTGGACCAGGAACTGGACATCAACCGGCTGTCCGACTACGATGTGGA

CCATATCGTGCCTCAGAGCTTTCTGAAGGACGACTCCATCGACAACAAGG

TGCTGACCAGAAGCGACAAGAACCGGGGCAAGAGCGACAACGTGCCCTCC

GAAGAGGTCGTGAAGAAGATGAAGAACTACTGGCGGCAGCTGCTGAACGC

CAAGCTGATTACCCAGAGAAAGTTCGACAATCTGACCAAGGCCGAGAGAG

GCGGCCTGAGCGAACTGGATAAGGCCGGCTTCATCAAGAGACAGCTGGTG

GAAACCCGGCAGATCACAAAGCACGTGGCACAGATCCTGGACTCCCGGAT

GAACACTAAGTACGACGAGAATGACAAGCTGATCCGGGAAGTGAAAGTGA

TCACCCTGAAGTCCAAGCTGGTGTCCGATTTCCGGAAGGATTTCCAGTTT

TACAAAGTGCGCGAGATCAACAACTACCACCACGCCCACGACGCCTACCT

GAACGCCGTCGTGGGAACCGCCCTGATCAAAAAGTACCCTAAGCTGGAAA

GCGAGTTCGTGTACGGCGACTACAAGGTGTACGACGTGCGGAAGATGATC

```
GCCAAGAGCGAGCAGGAAATCGGCAAGGCTACCGCCAAGTACTTCTTCTA

CAGCAACATCATGAACTTTTTCAAGACCGAGATTACCCTGGCCAACGGCG

AGATCCGGAAGCGGCCTCTGATCGAGACAAACGGCGAAACCGGGGAGATC

GTGTGGGATAAGGGCCGGGATTTTGCCACCGTGCGGAAAGTGCTGAGCAT

GCCCCAAGTGAATATCGTGAAAAAGACCGAGGTGCAGACAGGCGGCTTCA

GCAAAGAGTCTATCCTGCCCAAGAGGAACAGCGATAAGCTGATCGCCAGA

AAGAAGGACTGGGACCCTAAGAAGTACGGCGGCTTCGACAGCCCCACCGT

GGCCTATTCTGTGCTGGTGGTGGCCAAAGTGGAAAAGGGCAAGTCCAAGA

AACTGAAGAGTGTGAAAGAGCTGCTGGGGATCACCATCATGGAAAGAAGC

AGCTTCGAGAAGAATCCCATCGACTTTCTGGAAGCCAAGGGCTACAAAGA

AGTGAAAAAGGACCTGATCATCAAGCTGCCTAAGTACTCCCTGTTCGAGC

TGGAAAACGGCCGGAAGAGAATGCTGGCCTCTGCCGGCGAACTGCAGAAG

GGAAACGAACTGGCCCTGCCCTCCAAATATGTGAACTTCCTGTACCTGGC

CAGCCACTATGAGAAGCTGAAGGGCTCCCCCGAGGATAATGAGCAGAAAC

AGCTGTTTGTGGAACAGCACAAGCACTACCTGGACGAGATCATCGAGCAG

ATCAGCGAGTTCTCCAAGAGAGTGATCCTGGCCGACGCTAATCTGGACAA

AGTGCTGTCCGCCTACAACAAGCACCGGGATAAGCCCATCAGAGAGCAGG

CCGAGAATATCATCCACCTGTTTACCCTGACCAATCTGGGAGCCCCTGCC

GCCTTCAAGTACTTTGACACCACCATCGACCGGAAGAGGTACACCAGCAC

CAAAGAGGTGCTGGACGCCACCCTGATCCACCAGAGCATCACCGGCCTGT

ACGAGACACGGATCGACCTGTCTCAGCTGGGAGGCGACAAAAGGCCGGCG

GCCACGAAAAGGCCGGCCAGGCAAAAAAGAAAAAGtaa

7. Sp_A_hel 2-(GGGGS)3
helical domain 2 deletion (from ortholog
alignment) ("(GGGGS)3" disclosed as
SEQ ID NO: 9)
                                      (SEQ ID NO: 88)
ATGGCCCCAAAGAAGAAGCGGAAGGTCGGTATCCACGGAGTCCCAGCAGC

CGACAAGAAGTACAGCATCGGCCTGGACATCGGCACCAACTCTGTGGGCT

GGGCCGTGATCACCGACGAGTACAAGGTGCCCAGCAAGAAATTCAAGGTG

CTGGGCAACACCGACCGGCACAGCATCAAGAAGAACCTGATCGGAGCCCT

GCTGTTCGACAGCGGCGAAACAGCCGAGGCCACCCGGCTGAAGAGAACCG

CCAGAAGAAGATACACCAGACGGAAGAACCGGATCTGCTATCTGCAAGAG

ATCTTCAGCAACGAGATGGCCAAGGTGGACGACAGCTTCTTCCACAGACT

GGAAGAGTCCTTCCTGGTGGAAGAGGATAAGAAGCACGAGCGGCACCCCA

TCTTCGGCAACATCGTGGACGAGGTGGCCTACCACGAGAAGTACCCCACC

ATCTACCACCTGAGAAAGAAACTGGTGGACAGCACCGACAAGGCCGACCT

GCGGCTGATCTATCTGGCCCTGGCCCACATGATCAAGTTCCGGGGCCACT

TCCTGATCGAGGGCGACGGTGGCGGTGGCtcgGGTGGCGGTGGCtcgGGT

GGCGGTGGCtcgATCACCAAGGCCCCCCTGAGCGCCTCTATGATCAAGAG

ATACGACGAGCACCACCAGGACCTGACCCTGCTGAAAGCTCTCGTGCGGC

AGCAGCTGCCTGAGAAGTACAAAGAGATTTTCTTCGACCAGAGCAAGAAC

GGCTACGCCGGCTACATTGACGGCGGAGCCAGCCAGGAAGAGTTCTACAA

GTTCATCAAGCCCATCCTGGAAAAGATGGACGGCACCGAGGAACTGCTCG

TGAAGCTGAACAGAGAGGACCTGCTGCGGAAGCAGCGGACCTTCGACAAC

GGCAGCATCCCCCACCAGATCCACCTGGGAGAGCTGCACGCCATTCTGCG

GCGGCAGGAAGATTTTTACCCATTCCTGAAGGACAACCGGGAAAAGATCG

AGAAGATCCTGACCTTCCGCATCCCCTACTACGTGGGCCCTCTGGCCAGG

GGAAACAGCAGATTCGCCTGGATGACCAGAAAGAGCGAGGAAACCATCAC

CCCCTGGAACTTCGAGGAAGTGGTGGACAAGGGCGCTTCCGCCCAGAGCT

TCATCGAGCGGATGACCAACTTCGATAAGAACCTGCCCAACGAGAAGGTG

CTGCCCAAGCACAGCCTGCTGTACGAGTACTTCACCGTGTATAACGAGCT

GACCAAAGTGAAATACGTGACCGAGGGAATGAGAAAGCCCGCCTTCCTGA

GCGGCGAGCAGAAAAAGGCCATCGTGGACCTGCTGTTCAAGACCAACCGG

AAAGTGACCGTGAAGCAGCTGAAAGAGGACTACTTCAAGAAAATCGAGTG

CTTCGACTCCGTGGAAATCTCCGGCGTGGAAGATCGGTTCAACGCCTCCC

TGGGCACATACCACGATCTGCTGAAAATTATCAAGGACAAGGACTTCCTG

GACAATGAGGAAAACGAGGACATTCTGGAAGATATCGTGCTGACCCTGAC

ACTGTTTGAGGACAGAGAGATGATCGAGGAACGGCTGAAAACCTATGCCC

ACCTGTTCGACGACAAAGTGATGAAGCAGCTGAAGCGGCGGAGATACACC

GGCTGGGGCAGGCTGAGCCGGAAGCTGATCAACGGCATCCGGGACAAGCA

GTCCGGCAAGACAATCCTGGATTTCCTGAAGTCCGACGGCTTCGCCAACA

GAAACTTCATGCAGCTGATCCACGACGACAGCCTGACCTTTAAAGAGGAC

ATCCAGAAAGCCCAGGTGTCCGGCCAGGGCGATAGCCTGCACGAGCACAT

TGCCAATCTGGCCGGCAGCCCCGCCATTAAGAAGGGCATCCTGCAGACAG

TGAAGGTGGTGGACGAGCTCGTGAAAGTGATGGGCCGGCACAAGCCCGAG

AACATCGTGATCGAAATGGCCAGAGAGAACCAGACCACCCAGAAGGGACA

GAAGAACAGCCGCGAGAGAATGAAGCGGATCGAAGAGGGCATCAAAGAGC

TGGGCAGCCAGATCCTGAAAGAACACCCCGTGGAAAACACCCAGCTGCAG

AACGAGAAGCTGTACCTGTACTACCTGCAGAATGGGCGGGATATGTACGT

GGACCAGGAACTGGACATCAACCGGCTGTCCGACTACGATGTGGACCATA

TCGTGCCTCAGAGCTTTCTGAAGGACGACTCCATCGACAACAAGGTGCTG

ACCAGAAGCGACAAGAACCGGGGCAAGAGCGACAACGTGCCCTCCGAAGA

GGTCGTGAAGAAGATGAAGAACTACTGGCGGCAGCTGCTGAACGCCAAGC

TGATTACCCAGAGAAAGTTCGACAATCTGACCAAGGCCGAGAGAGGCGGC

CTGAGCGAACTGGATAAGGCCGGCTTCATCAAGAGACAGCTGGTGGAAAC

CCGGCAGATCACAAAGCACGTGGCACAGATCCTGGACTCCCGGATGAACA

CTAAGTACGACGAGAATGACAAGCTGATCCGGGAAGTGAAAGTGATCACC

CTGAAGTCCAAGCTGGTGTCCGATTTCCGGAAGGATTTCCAGTTTTACAA

AGTGCGCGAGATCAACAACTACCACCACGCCCACGACGCCTACCTGAACG

CCGTCGTGGGAACCGCCCTGATCAAAAAGTACCCTAAGCTGGAAAGCGAG

TTCGTGTACGGCGACTACAAGGTGTACGACGTGCGGAAGATGATCGCCAA

GAGCGAGCAGGAAATCGGCAAGGCTACCGCCAAGTACTTCTTCTACAGCA
```

```
ACATCATGAACTTTTTCAAGACCGAGATTACCCTGGCCAACGGCGAGATC
CGGAAGCGGCCTCTGATCGAGACAAACGGCGAAACCGGGGAGATCGTGTG
GGATAAGGGCCGGGATTTTGCCACCGTGCGGAAAGTGCTGAGCATGCCCC
AAGTGAATATCGTGAAAAAGACCGAGGTGCAGACAGGCGGCTTCAGCAAA
GAGTCTATCCTGCCCAAGAGGAACAGCGATAAGCTGATCGCCAGAAAGAA
GGACTGGGACCCTAAGAAGTACGGCGGCTTCGACAGCCCCACCGTGGCCT
ATTCTGTGCTGGTGGTGGCCAAAGTGGAAAAGGGCAAGTCCAAGAAACTG
AAGAGTGTGAAAGAGCTGCTGGGGATCACCATCATGGAAAGAAGCAGCTT
CGAGAAGAATCCCATCGACTTTCTGGAAGCCAAGGGCTACAAAGAAGTGA
AAAAGGACCTGATCATCAAGCTGCCTAAGTACTCCCTGTTCGAGCTGGAA
AACGGCCGGAAGAGAATGCTGGCCTCTGCCGGCGAACTGCAGAAGGGAAA
CGAACTGGCCCTGCCCTCCAAATATGTGAACTTCCTGTACCTGGCCAGCC
ACTATGAGAAGCTGAAGGGCTCCCCCGAGGATAATGAGCAGAAACAGCTG
TTTGTGGAACAGCACAAGCACTACCTGGACGAGATCATCGAGCAGATCAG
CGAGTTCTCCAAGAGAGTGATCCTGGCCGACGCTAATCTGGACAAAGTGC
TGTCCGCCTACAACAAGCACCGGGATAAGCCCATCAGAGAGCAGGCCGAG
AATATCATCCACCTGTTTACCCTGACCAATCTGGGAGCCCCTGCCGCCTT
CAAGTACTTTGACACCACCATCGACCGGAAGAGGTACACCAGCACCAAAG
AGGTGCTGGACGCCACCCTGATCCACCAGAGCATCACCGGCCTGTACGAG
ACACGGATCGACCTGTCTCAGCTGGGAGGCGACAAAAGGCCGGCGGCCAC
GAAAAAGGCCGGCCAGGCAAAAAAGAAAAAGtaa
```

8. Sp_A_hel 2-(GGGGS)6
helical domain 2 deletion (from ortholog alignment)
("(GGGGS)6" disclosed as SEQ ID NO: 10)
(SEQ ID NO: 89)
```
ATGGCCCCAAAGAAGAAGCGGAAGGTCGGTATCCACGGAGTCCCAGCAGC
CGACAAGAAGTACAGCATCGGCCTGGACATCGGCACCAACTCTGTGGGCT
GGGCCGTGATCACCGACGAGTACAAGGTGCCCAGCAAGAAATTCAAGGTG
CTGGGCAACACCGACCGGCACAGCATCAAGAAGAACCTGATCGGAGCCCT
GCTGTTCGACAGCGGCGAAACAGCCGAGGCCACCCGGCTGAAGAGAACCG
CCAGAAGAAGATACACCAGACGGAAGAACCGGATCTGCTATCTGCAAGAG
ATCTTCAGCAACGAGATGGCCAAGGTGGACGACAGCTTCTTCCACAGACT
GGAAGAGTCCTTCCTGGTGGAAGAGGATAAGAAGCACGAGCGGCACCCCA
TCTTCGGCAACATCGTGGACGAGGTGGCCTACCACGAGAAGTACCCCACC
ATCTACCACCTGAGAAAGAAACTGGTGGACAGCACCGACAAGGCCGACCT
GCGGCTGATCTATCTGGCCCTGGCCCACATGATCAAGTTCCGGGGCCACT
TCCTGATCGAGGGCGACGGTGGCGGTGGCtcgGGTGGCGGTGGCtcgGGT
GGCGGTGGCtcgGGTGGCGGTGGCtcgGGTGGCGGTGGCtcgGGTGGCGG
TGGCtcgATCACCAAGGCCCCCCTGAGCGCCTCTATGATCAAGAGATACG
ACGAGCACCACCAGGACCTGACCCTGCTGAAAGCTCTCGTGCGGCAGCAG
CTGCCTGAGAAGTACAAAGAGATTTTCTTCGACCAGAGCAAGAACGGCTA
CGCCGGCTACATTGACGGCGGAGCCAGCCAGGAAGAGTTCTACAAGTTCA
TCAAGCCCATCCTGGAAAAGATGGACGGCACCGAGGAACTGCTCGTGAAG
CTGAACAGAGAGGACCTGCTGCGGAAGCAGCGGACCTTCGACAACGGCAG
CATCCCCCACCAGATCCACCTGGGAGAGCTGCACGCCATTCTGCGGCGGC
AGGAAGATTTTTACCCATTCCTGAAGGACAACCGGGAAAAGATCGAGAAG
ATCCTGACCTTCCGCATCCCCTACTACGTGGGCCCTCTGGCCAGGGGAAA
CAGCAGATTCGCCTGGATGACCAGAAAGAGCGAGGAAACCATCACCCCCT
GGAACTTCGAGGAAGTGGTGGACAAGGGCGCTTCCGCCCAGAGCTTCATC
GAGCGGATGACCAACTTCGATAAGAACCTGCCCAACGAGAAGGTGCTGCC
CAAGCACAGCCTGCTGTACGAGTACTTCACCGTGTATAACGAGCTGACCA
AAGTGAAATACGTGACCGAGGGAATGAGAAAGCCCGCCTTCCTGAGCGGC
GAGCAGAAAAAGGCCATCGTGGACCTGCTGTTCAAGACCAACCGGAAAGT
GACCGTGAAGCAGCTGAAAGAGGACTACTTCAAGAAAATCGAGTGCTTCG
ACTCCGTGGAAATCTCCGGCGTGGAAGATCGGTTCAACGCCTCCCTGGGC
ACATACCACGATCTGCTGAAAATTATCAAGGACAAGGACTTCCTGGACAA
TGAGGAAAACGAGGACATTCTGGAAGATATCGTGCTGACCCTGACACTGT
TTGAGGACAGAGAGATGATCGAGGAACGGCTGAAAACCTATGCCCACCTG
TTCGACGACAAAGTGATGAAGCAGCTGAAGCGGCGGAGATACACCGGCTG
GGGCAGGCTGAGCCGGAAGCTGATCAACGGCATCCGGGACAAGCAGTCCG
GCAAGACAATCCTGGATTTCCTGAAGTCCGACGGCTTCGCCAACAGAAAC
TTCATGCAGCTGATCCACGACGACAGCCTGACCTTTAAAGAGGACATCCA
GAAAGCCCAGGTGTCCGGCCAGGGCGATAGCCTGCACGAGCACATTGCCA
ATCTGGCCGGCAGCCCCGCCATTAAGAAGGGCATCCTGCAGACAGTGAAG
GTGGTGGACGAGCTCGTGAAAGTGATGGGCCGGCACAAGCCCGAGAACAT
CGTGATCGAAATGGCCAGAGAGAACCAGACCACCCAGAAGGGACAGAAGA
ACAGCCGCGAGAGAATGAAGCGGATCGAAGAGGGCATCAAAGAGCTGGGC
AGCCAGATCCTGAAAGAACACCCCGTGGAAAACACCCAGCTGCAGAACGA
GAAGCTGTACCTGTACTACCTGCAGAATGGCCGGGATATGTACGTGGACC
AGGAACTGGACATCAACCGGCTGTCCGACTACGATGTGGACCATATCGTG
CCTCAGAGCTTTCTGAAGGACGACTCCATCGACAACAAGGTGCTGACCAG
AAGCGACAAGAACCGGGGCAAGAGCGACAACGTGCCCTCCGAAGAGGTCG
TGAAGAAGATGAAGAACTACTGGCGGCAGCTGCTGAACGCCAAGCTGATT
ACCCAGAGAAAGTTCGACAATCTGACCAAGGCCGAGAGAGGCGGCCTGAG
CGAACTGGATAAGGCCGGCTTCATCAAGAGACAGCTGGTGGAAACCCGGC
AGATCACAAAGCACGTGGCACAGATCCTGGACTCCCGGATGAACACTAAG
TACGACGAGAATGACAAGCTGATCCGGGAAGTGAAAGTGATCACCCTGAA
GTCCAAGCTGGTGTCCGATTTCCGGAAGGATTTCCAGTTTTACAAAGTGC
GCGAGATCAACAACTACCACCACGCCCACGACGCCTACCTGAACGCCGTC
GTGGGAACCGCCCTGATCAAAAAGTACCCTAAGCTGGAAAGCGAGTTCGT
GTACGGCGACTACAAGGTGTACGACGTGCGGAAGATGATCGCCAAGAGCG
AGCAGGAAATCGGCAAGGCTACCGCCAAGTACTTCTTCTACAGCAACATC
ATGAACTTTTTCAAGACCGAGATTACCCTGGCCAACGGCGAGATCCGGAA
```

-continued

```
GCGGCCTCTGATCGAGACAAACGGCGAAACCGGGGAGATCGTGTGGGATA

AGGGCCGGGATTTTGCCACCGTGCGGAAAGTGCTGAGCATGCCCCAAGTG

AATATCGTGAAAAAGACCGAGGTGCAGACAGGCGGCTTCAGCAAAGAGTC

TATCCTGCCCAAGAGGAACAGCGATAAGCTGATCGCCAGAAAGAAGGACT

GGGACCCTAAGAAGTACGGCGGCTTCGACAGCCCCACCGTGGCCTATTCT

GTGCTGGTGGTGGCCAAAGTGGAAAAGGGCAAGTCCAAGAAACTGAAGAG

TGTGAAAGAGCTGCTGGGGATCACCATCATGGAAAGAAGCAGCTTCGAGA

AGAATCCCATCGACTTTCTGGAAGCCAAGGGCTACAAAGAAGTGAAAAAG

GACCTGATCATCAAGCTGCCTAAGTACTCCCTGTTCGAGCTGGAAAACGG

CCCGGAAGAGAATGCTGGCCTCTGCCGGCGAACTGCAGAAGGGAAACGAAC

TGGCCCTGCCCTCCAAATATGTGAACTTCCTGTACCTGGCCAGCCACTAT

GAGAAGCTGAAGGGCTCCCCCGAGGATAATGAGCAGAAACAGCTGTTTGT

GGAACAGCACAAGCACTACCTGGACGAGATCATCGAGCAGATCAGCGAGT

TCTCCAAGAGAGTGATCCTGGCCGACGCTAATCTGGACAAAGTGCTGTCC

GCCTACAACAAGCACCGGGATAAGCCCATCAGAGAGCAGGCCGAGAATAT

CATCCACCTGTTTACCCTGACCAATCTGGGAGCCCCTGCCGCCTTCAAGT

ACTTTGACACCACCATCGACCGGAAGAGGTACACCAGCACCAAAGAGGTG

CTGGACGCCACCCTGATCCACCAGAGCATCACCGGCCTGTACGAGACACG

GATCGACCTGTCTCAGCTGGGAGGCGACAAAAGGCCGGCGGCCACGAAAA

AGGCCGGCCAGGCAAAAAAGAAAAAGtaa
```

9. Sp_A_hel 2-(GGGGS)9 helical
domain 2 deletion (from ortholog alignment)
("(GGGGS)9" disclosed as SEQ ID NO: 11)

(SEQ ID NO: 90)

```
ATGGCCCCAAAGAAGAAGCGGAAGGTCGGTATCCACGGAGTCCCAGCAGC

CGACAAGAAGTACAGCATCGGCCTGGACATCGGCACCAACTCTGTGGGCT

GGGCCGTGATCACCGACGAGTACAAGGTGCCCAGCAAGAAATTCAAGGTG

CTGGGCAACACCGACCGGCACAGCATCAAGAAGAACCTGATCGGAGCCCT

GCTGTTCGACAGCGGCGAAACAGCCGAGGCCACCCGGCTGAAGAGAACCG

CCAGAAGAAGATACACCAGACGGAAGAACCGGATCTGCTATCTGCAAGAG

ATCTTCAGCAACGAGATGGCCAAGGTGGACGACAGCTTCTTCCACAGACT

GGAAGAGTCCTTCCTGGTGGAAGAGGATAAGAAGCACGAGCGGCACCCCA

TCTTCGGCAACATCGTGGACGAGGTGGCCTACCACGAGAAGTACCCCACC

ATCTACCACCTGAGAAAGAAACTGGTGGACAGCACCGACAAGGCCGACCT

GCGGCTGATCTATCTGGCCCTGGCCCACATGATCAAGTTCCGGGGCCACT

TCCTGATCGAGGGCGACGGTGGCGGTGGCtcgGGTGGCGGTGGCtcgGGT

GGCGGTGGCtcgGGTGGCGGTGGCtcgGGTGGCGGTGGCtcgGGTGGCGG

TGGCtcgGGTGGCGGTGGCtcgGGTGGCGGTGGCtcgGGTGGCGGTGGCt cgATCACCAAGGCCCCCCTGAGCGCCTCTATGATCAAGAGATACGACGAG

CACCACCAGGACCTGACCCTGCTGAAAGCTCTCGTGCGGCAGCAGCTGCC

TGAGAAGTACAAAGAGATTTTCTTCGACCAGAGCAAGAACGGCTACGCCG

GCTACATTGACGGCGGAGCCAGCCAGGAAGAGTTCTACAAGTTCATCAAG
```

-continued

```
CCCATCCTGGAAAAGATGGACGGCACCGAGGAACTGCTCGTGAAGCTGAA

CAGAGAGGACCTGCTGCGGAAGCAGCGGACCTTCGACAACGGCAGCATCC

CCCACCAGATCCACCTGGGAGAGCTGCACGCCATTCTGCGGCGGCAGGAA

GATTTTTACCCATTCCTGAAGGACAACCGGGAAAAGATCGAGAAGATCCT

GACCTTCCGCATCCCCTACTACGTGGGCCCTCTGGCCAGGGGAAACAGCA

GATTCGCCTGGATGACCAGAAAGAGCGAGGAAACCATCACCCCCTGGAAC

TTCGAGGAAGTGGTGGACAAGGGCGCTTCCGCCCAGAGCTTCATCGAGCG

GATGACCAACTTCGATAAGAACCTGCCCAACGAGAAGGTGCTGCCCAAGC

ACAGCCTGCTGTACGAGTACTTCACCGTGTATAACGAGCTGACCAAAGTG

AAATACGTGACCGAGGGAATGAGAAAGCCCGCCTTCCTGAGCGGCGAGCA

GAAAAAGGCCATCGTGGACCTGCTGTTCAAGACCAACCGGAAAGTGACCG

TGAAGCAGCTGAAAGAGGACTACTTCAAGAAAATCGAGTGCTTCGACTCC

GTGGAAATCTCCGGCGTGGAAGATCGGTTCAACGCCTCCCTGGGCACATA

CCACGATCTGCTGAAAATTATCAAGGACAAGGACTTCCTGGACAATGAGG

AAAACGAGGACATTCTGGAAGATATCGTGCTGACCCTGACACTGTTTGAG

GACAGAGAGATGATCGAGGAACGGCTGAAAACCTATGCCCACCTGTTCGA

CGACAAAGTGATGAAGCAGCTGAAGCGGCGGAGATACACCGGCTGGGGCA

GGCTGAGCCGGAAGCTGATCAACGGCATCCGGGACAAGCAGTCCGGCAAG

ACAATCCTGGATTTCCTGAAGTCCGACGGCTTCGCCAACAGAAACTTCAT

GCAGCTGATCCACGACGACAGCCTGACCTTTAAAGAGGACATCCAGAAAG

CCCAGGTGTCCGGCCAGGGCGATAGCCTGCACGAGCACATTGCCAATCTG

GCCGGCAGCCCCGCCATTAAGAAGGGCATCCTGCAGACAGTGAAGGTGGT

GGACGAGCTCGTGAAAGTGATGGGCCGGCACAAGCCCGAGAACATCGTGA

TCGAAATGGCCAGAGAGAACCAGACCACCCAGAAGGGACAGAAGAACAGC

CGCGAGAGAATGAAGCGGATCGAAGAGGGCATCAAAGAGCTGGGCAGCCA

GATCCTGAAAGAACACCCCGTGGAAAACACCCAGCTGCAGAACGAGAAGC

TGTACCTGTACTACCTGCAGAATGGCCGGGATATGTACGTGGACCAGGAA

CTGGACATCAACCGGCTGTCCGACTACGATGTGGACCATATCGTGCCTCA

GAGCTTTCTGAAGGACGACTCCATCGACAACAAGGTGCTGACCAGAAGCG

ACAAGAACCGGGGCAAGAGCGACAACGTGCCCTCCGAAGAGGTCGTGAAG

AAGATGAAGAACTACTGGCGGCAGCTGCTGAACGCCAAGCTGATTACCCA

GAGAAAGTTCGACAATCTGACCAAGGCCGAGAGAGGCGGCCTGAGCGAAC

TGGATAAGGCCGGCTTCATCAAGAGACAGCTGGTGGAAACCCGGCAGATC

ACAAAGCACGTGGCACAGATCCTGGACTCCCGGATGAACACTAAGTACGA

CGAGAATGACAAGCTGATCCGGGAAGTGAAAGTGATCACCCTGAAGTCCA

AGCTGGTGTCCGATTTCCGGAAGGATTTCCAGTTTTACAAAGTGCGCGAG

ATCAACAACTACCACCACGCCCACGACGCCTACCTGAACGCCGTCGTGGG

AACCGCCCTGATCAAAAAGTACCCTAAGCTGGAAAGCGAGTTCGTGTACG

GCGACTACAAGGTGTACGACGTGCGGAAGATGATCGCCAAGAGCGAGCAG

GAAATCGGCAAGGCTACCGCCAAGTACTTCTTCTACAGCAACATCATGAA

CTTTTTTCAAGACCGAGATTACCCTGGCCAACGGCGAGATCCGGAAGCGGC
```

-continued

CTCTGATCGAGACAAACGGCGAAACCGGGGAGATCGTGTGGGATAAGGGC

CGGGATTTTGCCACCGTGCGGAAAGTGCTGAGCATGCCCCAAGTGAATAT

CGTGAAAAAGACCGAGGTGCAGACAGGCGGCTTCAGCAAAGAGTCTATCC

TGCCCAAGAGGAACAGCGATAAGCTGATCGCCAGAAAGAAGGACTGGGAC

CCTAAGAAGTACGGCGGCTTCGACAGCCCCACCGTGGCCTATTCTGTGCT

GGTGGTGGCCAAAGTGGAAAAGGGCAAGTCCAAGAAACTGAAGAGTGTGA

AAGAGCTGCTGGGGATCACCATCATGGAAAGAAGCAGCTTCGAGAAGAAT

CCCATCGACTTTCTGGAAGCCAAGGGCTACAAAGAAGTGAAAAAGGACCT

GATCATCAAGCTGCCTAAGTACTCCCTGTTCGAGCTGGAAAACGGCCGGA

AGAGAATGCTGGCCTCTGCCGGCGAACTGCAGAAGGGAAACGAACTGGCC

CTGCCCTCCAAATATGTGAACTTCCTGTACCTGGCCAGCCACTATGAGAA

GCTGAAGGGCTCCCCCGAGGATAATGAGCAGAAACAGCTGTTTGTGGAAC

AGCACAAGCACTACCTGGACGAGATCATCGAGCAGATCAGCGAGTTCTCC

AAGAGAGTGATCCTGGCCGACGCTAATCTGGACAAAGTGCTGTCCGCCTA

CAACAAGCACCGGGATAAGCCCATCAGAGAGCAGGCCGAGAATATCATCC

ACCTGTTTACCCTGACCAATCTGGGAGCCCCTGCCGCCTTCAAGTACTTT

GACACCACCATCGACCGGAAGAGGTACACCAGCACCAAAGAGGTGCTGGA

CGCCACCCTGATCCACCAGAGCATCACCGGCCTGTACGAGACACGGATCG

ACCTGTCTCAGCTGGGAGGCGACAAAAGGCCGGCGGCCACGAAAAAGGCC

GGCCAGGCAAAAAAGAAAAAGtaa

10. Sp_A_hel 2-(GGGGS)12 helical
domain 2 deletion (from ortholog alignment)
("(GGGGS)12" disclosed as SEQ ID NO: 12)
(SEQ ID NO: 91)

ATGGCCCCAAAGAAGAAGCGGAAGGTCGGTATCCACGGAGTCCCAGCAGC

CGACAAGAAGTACAGCATCGGCCTGGACATCGGCACCAACTCTGTGGGCT

GGGCCGTGATCACCGACGAGTACAAGGTGCCCAGCAAGAAATTCAAGGTG

CTGGGCAACACCGACCGGCACAGCATCAAGAAGAACCTGATCGGAGCCCT

GCTGTTCGACAGCGGCGAAACAGCCGAGGCCACCCGGCTGAAGAGAACCG

CCAGAAGAAGATACACCAGACGGAAGAACCGGATCTGCTATCTGCAAGAG

ATCTTCAGCAACGAGATGGCCAAGGTGGACGACAGCTTCTTCCACAGACT

GGAAGAGTCCTTCCTGGTGGAAGAGGATAAGAAGCACGAGCGGCACCCCA

TCTTCGGCAACATCGTGGACGAGGTGGCCTACCACGAGAAGTACCCCACC

ATCTACCACCTGAGAAAGAAACTGGTGGACAGCACCGACAAGGCCGACCT

GCGGCTGATCTATCTGGCCCTGGCCCACATGATCAAGTTCCGGGGCCACT

TCCTGATCGAGGGCGACGGTGGCGGTGGCtcgGGTGGCGGTGGCtcgGGT

GGCGGTGGCtcgGGTGGCGGTGGCtcgGGTGGCGGTGGCtcgGGTGGCGG

TGGCtcgGGTGGCGGTGGCtcgGGTGGCGGTGGCtcgGGTGGCGGTGGCt cgGGTGGCGGTGGCtcgGGTGGCGGTGGCtcgGGTGGCGGTGGCtcgATC

ACCAAGGCCCCCCTGAGCGCCTCTATGATCAAGAGATACGACGAGCACCA

CCAGGACCTGACCCTGCTGAAAGCTCTCGTGCGGCAGCAGCTGCCTGAGA

AGTACAAAGAGATTTTCTTCGACCAGAGCAAGAACGGCTACGCCGGCTAC

ATTGACGGCGGAGCCAGCCAGGAAGAGTTCTACAAGTTCATCAAGCCCAT

CCTGGAAAAGATGGACGGCACCGAGGAACTGCTCGTGAAGCTGAACAGAG

AGGACCTGCTGCGGAAGCAGCGGACCTTCGACAACGGCAGCATCCCCCAC

CAGATCCACCTGGGAGAGCTGCACGCCATTCTGCGGCGGCAGGAAGATTT

TTACCCATTCCTGAAGGACAACCGGGAAAAGATCGAGAAGATCCTGACCT

TCCGCATCCCCTACTACGTGGGCCCTCTGGCCAGGGGAAACAGCAGATTC

GCCTGGATGACCAGAAAGAGCGAGGAAACCATCACCCCCTGGAACTTCGA

GGAAGTGGTGGACAAGGGCGCTTCCGCCCAGAGCTTCATCGAGCGGATGA

CCAACTTCGATAAGAACCTGCCCAACGAGAAGGTGCTGCCCAAGCACAGC

CTGCTGTACGAGTACTTCACCGTGTATAACGAGCTGACCAAAGTGAAATA

CGTGACCGAGGGAATGAGAAAGCCCGCCTTCCTGAGCGGCGAGCAGAAAA

AGGCCATCGTGGACCTGCTGTTCAAGACCAACCGGAAAGTGACCGTGAAG

CAGCTGAAAGAGGACTACTTCAAGAAAATCGAGTGCTTCGACTCCGTGGA

AATCTCCGGCGTGGAAGATCGGTTCAACGCCTCCCTGGGCACATACCACG

ATCTGCTGAAAATTATCAAGGACAAGGACTTCCTGGACAATGAGGAAAAC

GAGGACATTCTGGAAGATATCGTGCTGACCCTGACACTGTTTGAGGACAG

AGAGATGATCGAGGAACGGCTGAAAACCTATGCCCACCTGTTCGACGACA

AAGTGATGAAGCAGCTGAAGCGGCGGAGATACACCGGCTGGGGCAGGCTG

AGCCGGAAGCTGATCAACGGCATCCGGGACAAGCAGTCCGGCAAGACAAT

CCTGGATTTCCTGAAGTCCGACGGCTTCGCCAACAGAAACTTCATGCAGC

TGATCCACGACGACAGCCTGACCTTTAAAGAGGACATCCAGAAAGCCCAG

GTGTCCGGCCAGGGCGATAGCCTGCACGAGCACATTGCCAATCTGGCCGG

CAGCCCCGCCATTAAGAAGGGCATCCTGCAGACAGTGAAGGTGGTGGACG

AGCTCGTGAAAGTGATGGGCCGGCACAAGCCCGAGAACATCGTGATCGAA

ATGGCCAGAGAGAACCAGACCACCCAGAAGGGACAGAAGAACAGCCGCGA

GAGAATGAAGCGGATCGAAGAGGGCATCAAAGAGCTGGGCAGCCAGATCC

TGAAAGAACACCCCGTGGAAAACACCCAGCTGCAGAACGAGAAGCTGTAC

CTGTACTACCTGCAGAATGGGCGGGATATGTACGTGGACCAGGAACTGGA

CATCAACCGGCTGTCCGACTACGATGTGGACCATATCGTGCCTCAGAGCT

TTCTGAAGGACGACTCCATCGACAACAAGGTGCTGACCAGAAGCGACAAG

AACCGGGGCAAGAGCGACAACGTGCCCTCCGAAGAGGTCGTGAAGAAGAT

GAAGAACTACTGGCGGCAGCTGCTGAACGCCAAGCTGATTACCCAGAGAA

AGTTCGACAATCTGACCAAGGCCGAGAGAGGCGGCCTGAGCGAACTGGAT

AAGGCCGGCTTCATCAAGAGACAGCTGGTGGAAACCCGGCAGATCACAAA

GCACGTGGCACAGATCCTGGACTCCCGGATGAACACTAAGTACGACGAGA

ATGACAAGCTGATCCGGGAAGTGAAAGTGATCACCCTGAAGTCCAAGCTG

GTGTCCGATTTCCGGAAGGATTTCCAGTTTTACAAAGTGCGCGAGATCAA

CAACTACCACCACGCCCACGACGCCTACCTGAACGCCGTCGTGGGAACCG

CCCTGATCAAAAAGTACCCTAAGCTGGAAAGCGAGTTCGTGTACGGCGAC

TACAAGGTGTACGACGTGCGGAAGATGATCGCCAAGAGCGAGCAGGAAAT

CGGCAAGGCTACCGCCAAGTACTTCTTCTACAGCAACATCATGAACTTTT

-continued

TCAAGACCGAGATTACCCTGGCCAACGGCGAGATCCGGAAGCGGCCTCTG

ATCGAGACAAACGGCGAAACCGGGGAGATCGTGTGGGATAAGGGCCGGGA

TTTTGCCACCGTGCGGAAAGTGCTGAGCATGCCCCAAGTGAATATCGTGA

AAAAGACCGAGGTGCAGACAGGCGGCTTCAGCAAAGAGTCTATCCTGCCC

AAGAGGAACAGCGATAAGCTGATCGCCAGAAAGAAGGACTGGGACCCTAA

GAAGTACGGCGGCTTCGACAGCCCCACCGTGGCCTATTCTGTGCTGGTGG

TGGCCAAAGTGGAAAAGGGCAAGTCCAAGAAACTGAAGAGTGTGAAAGAG

CTGCTGGGGATCACCATCATGGAAAGAAGCAGCTTCGAGAAGAATCCCAT

CGACTTTCTGGAAGCCAAGGGCTACAAAGAAGTGAAAAAGGACCTGATCA

TCAAGCTGCCTAAGTACTCCCTGTTCGAGCTGGAAAACGGCCGGAAGAGA

ATGCTGGCCTCTGCCGGCGAACTGCAGAAGGGAAACGAACTGGCCCTGCC

CTCCAAATATGTGAACTTCCTGTACCTGGCCAGCCACTATGAGAAGCTGA

AGGGCTCCCCCGAGGATAATGAGCAGAAACAGCTGTTTGTGGAACAGCAC

AAGCACTACCTGGACGAGATCATCGAGCAGATCAGCGAGTTCTCCAAGAG

AGTGATCCTGGCCGACGCTAATCTGGACAAAGTGCTGTCCGCCTACAACA

AGCACCGGGATAAGCCCATCAGAGAGCAGGCCGAGAATATCATCCACCTG

TTTACCCTGACCAATCTGGGAGCCCCTGCCGCCTTCAAGTACTTTGACAC

CACCATCGACCGGAAGAGGTACACCAGCACCAAAGAGGTGCTGGACGCCA

CCCTGATCCACCAGAGCATCACCGGCCTGTACGAGACACGGATCGACCTG

TCTCAGCTGGGAGGCGACAAAAGGCCGGCGGCCACGAAAAAGGCCGGCCA

GGCAAAAAGAAAAAGtaa

11. Sp_A_hel 2-A(EAAAK)3A helical
domain 2 deletion (from ortholog alignment)
("A(EAAAK)3A" disclosed as SEQ ID NO: 3)
(SEQ ID NO: 92)
ATGGCCCCAAAGAAGAAGCGGAAGGTCGGTATCCACGGAGTCCCAGCAGC

CGACAAGAAGTACAGCATCGGCCTGGACATCGGCACCAACTCTGTGGGCT

GGGCCGTGATCACCGACGAGTACAAGGTGCCCAGCAAGAAATTCAAGGTG

CTGGGCAACACCGACCGGCACAGCATCAAGAAGAACCTGATCGGAGCCCT

GCTGTTCGACAGCGGCGAAACAGCCGAGGCCACCCGGCTGAAGAGAACCG

CCAGAAGAAGATACACCAGACGGAAGAACCGGATCTGCTATCTGCAAGAG

ATCTTCAGCAACGAGATGGCCAAGGTGGACGACAGCTTCTTCCACAGACT

GGAAGAGTCCTTCCTGGTGGAAGAGGATAAGAAGCACGAGCGGCACCCCA

TCTTCGGCAACATCGTGGACGAGGTGGCCTACCACGAGAAGTACCCCACC

ATCTACCACCTGAGAAAGAAACTGGTGGACAGCACCGACAAGGCCGACCT

GCGGCTGATCTATCTGGCCCTGGCCCACATGATCAAGTTCCGGGGCCACT

TCCTGATCGAGGGCGACgctAAGCTGCTGCTAAAGAAGCTGCTGCTAAA

GAAGCTGCTGCTAAAgctATCACCAAGGCCCCCCTGAGCGCCTCTATGAT

CAAGAGATACGACGAGCACCACCAGGACCTGACCCTGCTGAAAGCTCTCG

TGCGGCAGCAGCTGCCTGAGAAGTACAAAGAGATTTTCTTCGACCAGAGC

AAGAACGGCTACGCCGGCTACATTGACGGCGGAGCCAGCCAGGAAGAGTT

CTACAAGTTCATCAAGCCCATCCTGGAAAAGATGGACGGCACCGAGGAAC

TGCTCGTGAAGCTGAACAGAGAGGACCTGCTGCGGAAGCAGCGGACCTTC

GACAACGGCAGCATCCCCCACCAGATCCACCTGGGAGAGCTGCACGCCAT

TCTGCGGCGGCAGGAAGATTTTTACCCATTCCTGAAGGACAACCGGGAAA

AGATCGAGAAGATCCTGACCTTCCGCATCCCCTACTACGTGGGCCCTCTG

GCCAGGGGAAACAGCAGATTCGCCTGGATGACCAGAAAGAGCGAGGAAAC

CATCACCCCCTGGAACTTCGAGGAAGTGGTGGACAAGGGCGCTTCCGCCC

AGAGCTTCATCGAGCGGATGACCAACTTCGATAAGAACCTGCCCAACGAG

AAGGTGCTGCCCAAGCACAGCCTGCTGTACGAGTACTTCACCGTGTATAA

CGAGCTGACCAAAGTGAAATACGTGACCGAGGGAATGAGAAAGCCCGCCT

TCCTGAGCGGCGAGCAGAAAAAGGCCATCGTGGACCTGCTGTTCAAGACC

AACCGGAAAGTGACCGTGAAGCAGCTGAAAGAGGACTACTTCAAGAAAAT

CGAGTGCTTCGACTCCGTGGAAATCTCCGGCGTGGAAGATCGGTTCAACG

CCTCCCTGGGCACATACCACGATCTGCTGAAAATTATCAAGGACAAGGAC

TTCCTGGACAATGAGGAAAACGAGGACATTCTGGAAGATATCGTGCTGAC

CCTGACACTGTTTGAGGACAGAGAGATGATCGAGGAACGGCTGAAAACCT

ATGCCCACCTGTTCGACGACAAAGTGATGAAGCAGCTGAAGCGGCGGAGA

TACACCGGCTGGGCAGGCTGAGCCGGAAGCTGATCAACGGCATCCGGGA

CAAGCAGTCCGGCAAGACAATCCTGGATTTCCTGAAGTCCGACGGCTTCG

CCAACAGAAACTTCATGCAGCTGATCCACGACGACAGCCTGACCTTTAAA

GAGGACATCCAGAAAGCCCAGGTGTCCGGCCAGGGCGATAGCCTGCACGA

GCACATTGCCAATCTGGCCGGCAGCCCCGCCATTAAGAAGGGCATCCTGC

AGACAGTGAAGGTGGTGGACGAGCTCGTGAAAGTGATGGGCCGGCACAAG

CCCGAGAACATCGTGATCGAAATGGCCAGAGAGAACCAGACCACCCAGAA

GGGACAGAAGAACAGCCGCGAGAGAATGAAGCGGATCGAAGAGGGCATCA

AAGAGCTGGGCAGCCAGATCCTGAAAGAACACCCCGTGGAAAACACCCAG

CTGCAGAACGAGAAGCTGTACCTGTACTACCTGCAGAATGGGCGGGATAT

GTACGTGGACCAGGAACTGGACATCAACCGGCTGTCCGACTACGATGTGG

ACCATATCGTGCCTCAGAGCTTTCTGAAGGACGACTCCATCGACAACAAG

GTGCTGACCAGAAGCGACAAGAACCGGGGCAAGAGCGACAACGTGCCCTC

CGAAGAGGTCGTGAAGAAGATGAAGAACTACTGGCGGCAGCTGCTGAACG

CCAAGCTGATTACCCAGAGAAAGTTCGACAATCTGACCAAGGCCGAGAGA

GGCGGCCTGAGCGAACTGGATAAGGCCGGCTTCATCAAGAGACAGCTGGT

GGAAACCCGGCAGATCACAAAGCACGTGGCACAGATCCTGGACTCCCGGA

TGAACACTAAGTACGACGAGAATGACAAGCTGATCCGGGAAGTGAAAGTG

ATCACCCTGAAGTCCAAGCTGGTGTCCGATTTCCGGAAGGATTTCCAGTT

TTACAAAGTGCGCGAGATCAACAACTACCACCACGCCCACGACGCCTACC

TGAACGCCGTCGTGGGAACCGCCCTGATCAAAAAGTACCCTAAGCTGGAA

AGCGAGTTCGTGTACGGCGACTACAAGGTGTACGACGTGCGGAAGATGAT

CGCCAAGAGCGAGCAGGAAATCGGCAAGGCTACCGCCAAGTACTTCTTCT

ACAGCAACATCATGAACTTTTTCAAGACCGAGATTACCCTGGCCAACGGC

GAGATCCGGAAGCGGCCTCTGATCGAGACAAACGGCGAAACCGGGGAGAT

```
CGTGTGGGATAAGGGCCGGGATTTTGCCACCGTGCGGAAAGTGCTGAGCA
TGCCCCAAGTGAATATCGTGAAAAAGACCGAGGTGCAGACAGGCGGCTTC
AGCAAAGAGTCTATCCTGCCCAAGAGGAACAGCGATAAGCTGATCGCCAG
AAAGAAGGACTGGGACCCTAAGAAGTACGGCGGCTTCGACAGCCCCACCG
TGGCCTATTCTGTGCTGGTGGTGGCCAAAGTGGAAAAGGGCAAGTCCAAG
AAACTGAAGAGTGTGAAAGAGCTGCTGGGGATCACCATCATGGAAAGAAG
CAGCTTCGAGAAGAATCCCATCGACTTTCTGGAAGCCAAGGGCTACAAAG
AAGTGAAAAAGGACCTGATCATCAAGCTGCCTAAGTACTCCCTGTTCGAG
CTGGAAAACGGCCGGAAGAGAATGCTGGCCTCTGCCGGCGAACTGCAGAA
GGGAAACGAACTGGCCCTGCCCTCCAAATATGTGAACTTCCTGTACCTGG
CCAGCCACTATGAGAAGCTGAAGGGCTCCCCCGAGGATAATGAGCAGAAA
CAGCTGTTTGTGGAACAGCACAAGCACTACCTGGACGAGATCATCGAGCA
GATCAGCGAGTTCTCCAAGAGAGTGATCCTGGCCGACGCTAATCTGGACA
AAGTGCTGTCCGCCTACAACAAGCACCGGGATAAGCCCATCAGAGAGCAG
GCCGAGAATATCATCCACCTGTTTACCCTGACCAATCTGGGAGCCCCTGC
CGCCTTCAAGTACTTTGACACCACCATCGACCGGAAGAGGTACACCAGCA
CCAAAGAGGTGCTGGACGCCACCCTGATCCACCAGAGCATCACCGGCCTG
TACGAGACACGGATCGACCTGTCTCAGCTGGGAGGCGACAAAAGGCCGGC
GGCCACGAAAAAGGCCGGCCAGGCAAAAAAGAAAAAGtaa 12. Sp_A_hel 2-A(EAAAK)3ALEA(EAAAK)3A
helical domain 2 deletion (from ortholog
alignment) ("A(EAAAK)3ALEA(EAAAK)3A"
disclosed as SEQ ID NO: 93)
                              (SEQ ID NO: 94)
ATGGCCCCAAAGAAGAAGCGGAAGGTCGGTATCCACGGAGTCCCAGCAGC
CGACAAGAAGTACAGCATCGGCCTGGACATCGGCACCAACTCTGTGGGCT
GGGCCGTGATCACCGACGAGTACAAGGTGCCCAGCAAGAAATTCAAGGTG
CTGGGCAACACCGACCGGCACAGCATCAAGAAGAACCTGATCGGAGCCCT
GCTGTTCGACAGCGGCGAAACAGCCGAGGCCACCCGGCTGAAGAGAACCG
CCAGAAGAAGATACACCAGACGGAAGAACCGGATCTGCTATCTGCAAGAG
ATCTTCAGCAACGAGATGGCCAAGGTGGACGACAGCTTCTTCCACAGACT
GGAAGAGTCCTTCCTGGTGGAAGAGGATAAGAAGCACGAGCGGCACCCCA
TCTTCGGCAACATCGTGGACGAGGTGGCCTACCACGAGAAGTACCCCACC
ATCTACCACCTGAGAAAGAAACTGGTGGACAGCACCGACAAGGCCGACCT
GCGGCTGATCTATCTGGCCCTGGCCCACATGATCAAGTTCCGGGGCCACT
TCCTGATCGAGGGCGACgctGAAGCCGCTGCTAAAGAAGCcGCTGCTAAA
GAAGCcGCTGCTAAAGccCTGGAGgctGAAGCcGCTGCTAAAGAAGCcGC
TGCTAAAGAAGCCGCTGCTAAAgctATCACCAAGGCCCCCCTGAGCGCCT
CTATGATCAAGAGATACGACGAGCACCACCAGGACCTGACCCTGCTGAAA
GCTCTCGTGCGGCAGCAGCTGCCTGAGAAGTACAAAGAGATTTTCTTCGA
CCAGAGCAAGAACGGCTACGCCGGCTACATTGACGGCGGAGCCAGCCAGG
AAGAGTTCTACAAGTTCATCAAGCCCATCCTGGAAAAGATGGACGGCACC
GAGGAACTGCTCGTGAAGCTGAACAGAGAGGACCTGCTGCGGAAGCAGCG
GACCTTCGACAACGGCAGCATCCCCCACCAGATCCACCTGGGAGAGCTGC
ACGCCATTCTGCGGCGGCAGGAAGATTTTTACCCATTCCTGAAGGACAAC
CGGGAAAAGATCGAGAAGATCCTGACCTTCCGCATCCCCTACTACGTGGG
CCCTCTGGCCAGGGGAAACAGCAGATTCGCCTGGATGACCAGAAAGAGCG
AGGAAACCATCACCCCCTGGAACTTCGAGGAAGTGGTGGACAAGGGCGCT
TCCGCCCAGAGCTTCATCGAGCGGATGACCAACTTCGATAAGAACCTGCC
CAACGAGAAGGTGCTGCCCAAGCACAGCCTGCTGTACGAGTACTTCACCG
TGTATAACGAGCTGACCAAAGTGAAATACGTGACCGAGGGAATGAGAAAG
CCCGCCTTCCTGAGCGGCGAGCAGAAAAAGGCCATCGTGGACCTGCTGTT
CAAGACCAACCGGAAAGTGACCGTGAAGCAGCTGAAAGAGGACTACTTCA
AGAAAATCGAGTGCTTCGACTCCGTGGAAATCTCCGGCGTGGAAGATCGG
TTCAACGCCTCCCTGGGCACATACCACGATCTGCTGAAAATTATCAAGGA
CAAGGACTTCCTGGACAATGAGGAAAACGAGGACATTCTGGAAGATATCG
TGCTGACCCTGACACTGTTTGAGGACAGAGAGATGATCGAGGAACGGCTG
AAAACCTATGCCCACCTGTTCGACGACAAAGTGATGAAGCAGCTGAAGCG
GCGGAGATACACCGGCTGGGGCAGGCTGAGCCGGAAGCTGATCAACGGCA
TCCGGGACAAGCAGTCCGGCAAGACAATCCTGGATTTCCTGAAGTCCGAC
GGCTTCGCCAACAGAAACTTCATGCAGCTGATCCACGACGACAGCCTGAC
CTTTAAAGAGGACATCCAGAAAGCCCAGGTGTCCGGCCAGGGCGATAGCC
TGCACGAGCACATTGCCAATCTGGCCGGCAGCCCCGCCATTAAGAAGGGC
ATCCTGCAGACAGTGAAGGTGGTGGACGAGCTCGTGAAAGTGATGGGCCG
GCACAAGCCCGAGAACATCGTGATCGAAATGGCCAGAGAGAACCAGACCA
CCCAGAAGGGACAGAAGAACAGCCGCGAGAGAATGAAGCGGATCGAAGAG
GGCATCAAAGAGCTGGGCAGCCAGATCCTGAAAGAACACCCCGTGGAAAA
CACCCAGCTGCAGAACGAGAAGCTGTACCTGTACTACCTGCAGAATGGGC
GGGATATGTACGTGGACCAGGAACTGGACATCAACCGGCTGTCCGACTAC
GATGTGGACCATATCGTGCCTCAGAGCTTTCTGAAGGACGACTCCATCGA
CAACAAGGTGCTGACCAGAAGCGACAAGAACCGGGGCAAGAGCGACAACG
TGCCCTCCGAAGAGGTCGTGAAGAAGATGAAGAACTACTGGCGGCAGCTG
CTGAACGCCAAGCTGATTACCCAGAGAAAGTTCGACAATCTGACCAAGGC
CGAGAGAGGCGGCCTGAGCGAACTGGATAAGGCCGGCTTCATCAAGAGAC
AGCTGGTGGAAACCCGGCAGATCACAAAGCACGTGGCACAGATCCTGGAC
TCCCGGATGAACACTAAGTACGACGAGAATGACAAGCTGATCCGGGAAGT
GAAAGTGATCACCCTGAAGTCCAAGCTGGTGTCCGATTTCCGGAAGGATT
TCCAGTTTTACAAAGTGCGCGAGATCAACAACTACCACCACGCCCACGAC
GCCTACCTGAACGCCGTCGTGGGAACCGCCCTGATCAAAAAGTACCCTAA
GCTGGAAAGCGAGTTCGTGTACGGCGACTACAAGGTGTACGACGTGCGGA
AGATGATCGCCAAGAGCGAGCAGGAAATCGGCAAGGCTACCGCCAAGTAC
TTCTTCTACAGCAACATCATGAACTTTTTCAAGACCGAGATTACCCTGGC
CAACGGCGAGATCCGGAAGCGGCCTCTGATCGAGACAAACGGCGAAACCG
```

```
GGGAGATCGTGTGGGATAAGGGCCGGGATTTTGCCACCGTGCGGAAAGTG

CTGAGCATGCCCCAAGTGAATATCGTGAAAAAGACCGAGGTGCAGACAGG

CGGCTTCAGCAAAGAGTCTATCCTGCCCAAGAGGAACAGCGATAAGCTGA

TCGCCAGAAAGAAGGACTGGGACCCTAAGAAGTACGCGGCTTCGACAGC

CCCACCGTGGCCTATTCTGTGCTGGTGGTGGCCAAAGTGGAAAAGGGCAA

GTCCAAGAAACTGAAGAGTGTGAAAGAGCTGCTGGGGATCACCATCATGG

AAAGAAGCAGCTTCGAGAAGAATCCCATCGACTTTCTGGAAGCCAAGGGC

TACAAAGAAGTGAAAAAGGACCTGATCATCAAGCTGCCTAAGTACTCCCT

GTTCGAGCTGGAAAACGGCCGGAAGAGAATGCTGGCCTCTGCCGGCGAAC

TGCAGAAGGGAAACGAACTGGCCCTGCCCTCCAAATATGTGAACTTCCTG

TACCTGGCCAGCCACTATGAGAAGCTGAAGGGCTCCCCCGAGGATAATGA

GCAGAAACAGCTGTTTGTGGAACAGCACAAGCACTACCTGGACGAGATCA

TCGAGCAGATCAGCGAGTTCTCCAAGAGAGTGATCCTGGCCGACGCTAAT

CTGGACAAAGTGCTGTCCGCCTACAACAAGCACCGGGATAAGCCCATCAG

AGAGCAGGCCGAGAATATCATCCACCTGTTTACCCTGACCAATCTGGGAG

CCCCTGCCGCCTTCAAGTACTTTGACACCACCATCGACCGGAAGAGGTAC

ACCAGCACCAAAGAGGTGCTGGACGCCACCCTGATCCACCAGAGCATCAC

CGGCCTGTACGAGACACGGATCGACCTGTCTCAGCTGGGAGGCGACAAAA

GGCCGGCGGCCACGAAAAAGGCCGGCCAGGCAAAAAAGAAAAAGtaa

13. Sp_A_hel
2-A(EAAAK)3ALEA(EAAAK)3ALEA(EAAAK)3A helical
domain 2 deletion (from ortholog alignment)
("A(EAAAK)3ALEA(EAAAK)3ALEA(EAAAK)3A"
disclosed as SEQ ID NO: 95)
                                       (SEQ ID NO: 96)
ATGGCCCCAAAGAAGAAGCGGAAGGTCGGTATCCACGGAGTCCCAGCAGC

CGACAAGAAGTACAGCATCGGCCTGGACATCGGCACCAACTCTGTGGGCT

GGGCCGTGATCACCGACGAGTACAAGGTGCCCAGCAAGAAATTCAAGGTG

CTGGGCAACACCGACCGGCACAGCATCAAGAAGAACCTGATCGGAGCCCT

GCTGTTCGACAGCGGCGAAACAGCCGAGGCCACCCGGCTGAAGAGAACCG

CCAGAAGAAGATACACCAGACGGAAGAACCGGATCTGCTATCTGCAAGAG

ATCTTCAGCAACGAGATGGCCAAGGTGGACGACAGCTTCTTCCACAGACT

GGAAGAGTCCTTCCTGGTGGAAGAGGATAAGAAGCACGAGCGGCACCCCA

TCTTCGGCAACATCGTGGACGAGGTGGCCTACCACGAGAAGTACCCCACC

ATCTACCACCTGAGAAAGAAACTGGTGGACAGCACCGACAAGGCCGACCT

GCGGCTGATCTATCTGGCCCTGGCCCACATGATCAAGTTCCGGGGCCACT

TCCTGATCGAGGGCGACgctGAAGCTGCTGCTAAAGAAGCTGCTGCTAAA

GAAGCTGCTGCTAAAGccCTGGAGgctGAAGCTGCTGCTAAAGAAGCTGC

TGCTAAAGAAGCTGCTGCTAAAGccCTGGAGgctGAAGCTGCTGCTAAAG

AAGCTGCTGCTAAAGAAGCTGCTGCTAAAgctATCACCAAGGCCCCCCTG

AGCGCCTCTATGATCAAGAGATACGACGAGCACCACCAGGACCTGACCCT

GCTGAAAGCTCTCGTGCGGCAGCAGCTGCCTGAGAAGTACAAAGAGATTT

TCTTCGACCAGAGCAAGAACGGCTACGCCGGCTACATTGACGGCGGAGCC

AGCCAGGAAGAGTTCTACAAGTTCATCAAGCCCATCCTGGAAAAGATGGA

CGGCACCGAGGAACTGCTCGTGAAGCTGAACAGAGAGGACCTGCTGCGGA

AGCAGCGGACCTTCGACAACGGCAGCATCCCCCACCAGATCCACCTGGGA

GAGCTGCACGCCATTCTGCGGCGGCAGGAAGATTTTTACCCATTCCTGAA

GGACAACCGGGAAAAGATCGAGAAGATCCTGACCTTCCGCATCCCCTACT

ACGTGGGCCCTCTGGCCAGGGGAAACAGCAGATTCGCCTGGATGACCAGA

AAGAGCGAGGAAACCATCACCCCCTGGAACTTCGAGGAAGTGGTGGACAA

GGGCGCTTCCGCCCAGAGCTTCATCGAGCGGATGACCAACTTCGATAAGA

ACCTGCCCAACGAGAAGGTGCTGCCCAAGCACAGCCTGCTGTACGAGTAC

TTCACCGTGTATAACGAGCTGACCAAAGTGAAATACGTGACCGAGGGAAT

GAGAAAGCCCGCCTTCCTGAGCGGCGAGCAGAAAAAGGCCATCGTGGACC

TGCTGTTCAAGACCAACCGGAAAGTGACCGTGAAGCAGCTGAAAGAGGAC

TACTTCAAGAAAATCGAGTGCTTCGACTCCGTGGAAATCTCCGGCGTGGA

AGATCGGTTCAACGCCTCCCTGGGCACATACCACGATCTGCTGAAAATTA

TCAAGGACAAGGACTTCCTGGACAATGAGGAAAACGAGGACATTCTGGAA

GATATCGTGCTGACCCTGACACTGTTTGAGGACAGAGAGATGATCGAGGA

ACGGCTGAAAACCTATGCCCACCTGTTCGACGACAAAGTGATGAAGCAGC

TGAAGCGGCGGAGATACACCGGCTGGGGCAGGCTGAGCCGGAAGCTGATC

AACGGCATCCGGGACAAGCAGTCCGGCAAGACAATCCTGGATTTCCTGAA

GTCCGACGGCTTCGCCAACAGAAACTTCATGCAGCTGATCCACGACGACA

GCCTGACCTTTAAAGAGGACATCCAGAAAGCCCAGGTGTCCGGCCAGGGC

GATAGCCTGCACGAGCACATTGCCAATCTGGCCGGCAGCCCCGCCATTAA

GAAGGGCATCCTGCAGACAGTGAAGGTGGTGGACGAGCTCGTGAAAGTGA

TGGGCCGGCACAAGCCCGAGAACATCGTGATCGAAATGGCCAGAGAGAAC

CAGACCACCCAGAAGGGACAGAAGAACAGCCGCGAGAGAATGAAGCGGAT

CGAAGAGGGCATCAAAGAGCTGGGCAGCCAGATCCTGAAAGAACACCCCG

TGGAAAACACCCAGCTGCAGAACGAGAAGCTGTACCTGTACTACCTGCAG

AATGGGCGGGATATGTACGTGGACCAGGAACTGGACATCAACCGGCTGTC

CGACTACGATGTGGACCATATCGTGCCTCAGAGCTTTCTGAAGGACGACT

CCATCGACAACAAGGTGCTGACCAGAAGCGACAAGAACCGGGGCAAGAGC

GACAACGTGCCCTCCGAAGAGGTCGTGAAGAAGATGAAGAACTACTGGCG

GCAGCTGCTGAACGCCAAGCTGATTACCCAGAGAAAGTTCGACAATCTGA

CCAAGGCCGAGAGAGGCGGCCTGAGCGAACTGGATAAGGCCGGCTTCATC

AAGAGACAGCTGGTGGAAACCCGGCAGATCACAAAGCACGTGGCACAGAT

CCTGGACTCCCGGATGAACACTAAGTACGACGAGAATGACAAGCTGATCC

GGGAAGTGAAAGTGATCACCCTGAAGTCCAAGCTGGTGTCCGATTTCCGG

AAGGATTTCCAGTTTTACAAAGTGCGCGAGATCAACAACTACCACCACGC

CCACGACGCCTACCTGAACGCCGTCGTGGGAACCGCCCTGATCAAAAAGT

ACCCTAAGCTGGAAAGCGAGTTCGTGTACGGCGACTACAAGGTGTACGAC

GTGCGGAAGATGATCGCCAAGAGCGAGCAGGAAATCGGCAAGGCTACCGC

CAAGTACTTCTTCTACAGCAACATCATGAACTTTTTCAAGACCGAGATTA
```

-continued

```
CCCTGGCCAACGGCGAGATCCGGAAGCGGCCTCTGATCGAGACAAACGGC
GAAACCGGGGAGATCGTGTGGGATAAGGGCCGGGATTTTGCCACCGTGCG
GAAAGTGCTGAGCATGCCCCAAGTGAATATCGTGAAAAAGACCGAGGTGC
AGACAGGCGGCTTCAGCAAAGAGTCTATCCTGCCCAAGAGGAACAGCGAT
AAGCTGATCGCCAGAAAGAAGGACTGGGACCCTAAGAAGTACGGCGGCTT
CGACAGCCCCACCGTGGCCTATTCTGTGCTGGTGGTGGCCAAAGTGGAAA
AGGGCAAGTCCAAGAAACTGAAGAGTGTGAAAGAGCTGCTGGGGATCACC
ATCATGGAAAGAAGCAGCTTCGAGAAGAATCCCATCGACTTTCTGGAAGC
CAAGGGCTACAAAGAAGTGAAAAAGGACCTGATCATCAAGCTGCCTAAGT
ACTCCCTGTTCGAGCTGGAAAACGGCCGGAAGAGAATGCTGGCCTCTGCC
GGCGAACTGCAGAAGGGAAACGAACTGGCCCTGCCCTCCAAATATGTGAA
CTTCCTGTACCTGGCCAGCCACTATGAGAAGCTGAAGGGCTCCCCCGAGG
ATAATGAGCAGAAACAGCTGTTTGTGGAACAGCACAAGCACTACCTGGAC
GAGATCATCGAGCAGATCAGCGAGTTCTCCAAGAGAGTGATCCTGGCCGA
CGCTAATCTGGACAAAGTGCTGTCCGCCTACAACAAGCACCGGGATAAGC
CCATCAGAGAGCAGGCCGAGAATATCATCCACCTGTTTACCCTGACCAAT
CTGGGAGCCCCTGCCGCCTTCAAGTACTTTGACACCACCATCGACCGGAA
GAGGTACACCAGCACCAAAGAGGTGCTGGACGCCACCCTGATCCACCAGA
GCATCACCGGCCTGTACGAGACACGGATCGACCTGTCTCAGCTGGGAGGC
GACAAAAGGCCGGCGGCCACGAAAAAGGCCGGCCAGGCAAAAAAGAAAAA
Gtaa
```

14. Sp_del_hel 2-
A(EAAAK)3ALEA(EAAAK)3ALEA(EAAAK)3ALEA(EAAAK)3A
helical domain 2 deletion (from ortholog
alignment)
("A(EAAAK)3ALEA(EAAAK)3ALEA(EAAAK)3ALEA(EAAAK)3A"
disclosed as SEQ ID NO: 97)

(SEQ ID NO: 98)

```
ATGGCCCCAAAGAAGAAGCGGAAGGTCGGTATCCACGGAGTCCCAGCAGC
CGACAAGAAGTACAGCATCGGCCTGGACATCGGCACCAACTCTGTGGGCT
GGGCCGTGATCACCGACGAGTACAAGGTGCCCAGCAAGAAATTCAAGGTG
CTGGGCAACACCGACCGGCACAGCATCAAGAAGAACCTGATCGGAGCCCT
GCTGTTCGACAGCGGCGAAACAGCCGAGGCCACCCGGCTGAAGAGAACCG
CCAGAAGAAGATACACCAGACGGAAGAACCGGATCTGCTATCTGCAAGAG
ATCTTCAGCAACGAGATGGCCAAGGTGGACGACAGCTTCTTCCACAGACT
GGAAGAGTCCTTCCTGGTGGAAGAGGATAAGAAGCACGAGCGGCACCCCA
TCTTCGGCAACATCGTGGACGAGGTGGCCTACCACGAGAAGTACCCCACC
ATCTACCACCTGAGAAAGAAACTGGTGGACAGCACCGACAAGGCCGACCT
GCGGCTGATCTATCTGGCCCTGGCCCACATGATCAAGTTCCGGGGCCACT
TCCTGATCGAGGGCGACgctGAAGCTGCTGCTAAAGAAGCTGCTGCTAAA
GAAGCTGCTGCTAAAGccCTGGAGgctGAAGCTGCTGCTAAAGAAGCTGC
TGCTAAAGAAGCTGCTGCTAAAGccCTGGAGgctGAAGCTGCTGCTAAAG
AAGCTGCTGCTAAAGAAGCTGCTGCTAAAGccCTGGAGgctGAAGCTGCT
GCTAAAGAAGCTGCTGCTAAAGAAGCTGCTGCTAAAGctATCACCAAGGC
```

-continued

```
CCCCCTGAGCGCCTCTATGATCAAGAGATACGACGAGCACCACCAGGACC
TGACCCTGCTGAAAGCTCTCGTGCGGCAGCAGCTGCCTGAGAAGTACAAA
GAGATTTTCTTCGACCAGAGCAAGAACGGCTACGCCGGCTACATTGACGG
CGGAGCCAGCCAGGAAGAGTTCTACAAGTTCATCAAGCCCATCCTGGAAA
AGATGGACGGCACCGAGGAACTGCTCGTGAAGCTGAACAGAGAGGACCTG
CTGCGGAAGCAGCGGACCTTCGACAACGGCAGCATCCCCCACCAGATCCA
CCTGGGAGAGCTGCACGCCATTCTGCGGCGGCAGGAAGATTTTTACCCAT
TCCTGAAGGACAACCGGGAAAAGATCGAGAAGATCCTGACCTTCCGCATC
CCCTACTACGTGGGCCCTCTGGCCAGGGGAAACAGCAGATTCGCCTGGAT
GACCAGAAAGAGCGAGGAAACCATCACCCCCTGGAACTTCGAGGAAGTGG
TGGACAAGGGCGCTTCCGCCCAGAGCTTCATCGAGCGGATGACCAACTTC
GATAAGAACCTGCCCAACGAGAAGGTGCTGCCCAAGCACAGCCTGCTGTA
CGAGTACTTCACCGTGTATAACGAGCTGACCAAAGTGAAATACGTGACCG
AGGGAATGAGAAAGCCCGCCTTCCTGAGCGGCGAGCAGAAAAAGGCCATC
GTGGACCTGCTGTTCAAGACCAACCGGAAAGTGACCGTGAAGCAGCTGAA
AGAGGACTACTTCAAGAAAATCGAGTGCTTCGACTCCGTGGAAATCTCCG
GCGTGGAAGATCGGTTCAACGCCTCCCTGGGCACATACCACGATCTGCTG
AAAATTATCAAGGACAAGGACTTCCTGGACAATGAGGAAAACGAGGACAT
TCTGGAAGATATCGTGCTGACCCTGACACTGTTTGAGGACAGAGAGATGA
TCGAGGAACGGCTGAAAACCTATGCCCACCTGTTCGACGACAAAGTGATG
AAGCAGCTGAAGCGGCGGAGATACACCGGCTGGGGCAGGCTGAGCCGGAA
GCTGATCAACGGCATCCGGGACAAGCAGTCCGGCAAGACAATCCTGGATT
TCCTGAAGTCCGACGGCTTCGCCAACAGAAACTTCATGCAGCTGATCCAC
GACGACAGCCTGACCTTTAAAGAGGACATCCAGAAAGCCCAGGTGTCCGG
CCAGGGCGATAGCCTGCACGAGCACATTGCCAATCTGGCCGGCAGCCCCG
CCATTAAGAAGGGCATCCTGCAGACAGTGAAGGTGGTGGACGAGCTCGTG
AAAGTGATGGGCCGGCACAAGCCCGAGAACATCGTGATCGAAATGGCCAG
AGAGAACCAGACCACCCAGAAGGGACAGAAGAACAGCCGCGAGAGAATGA
AGCGGATCGAAGAGGGCATCAAAGAGCTGGGCAGCCAGATCCTGAAAGAA
CACCCCGTGGAAAACACCCAGCTGCAGAACGAGAAGCTGTACCTGTACTA
CCTGCAGAATGGCCGGGATATGTACGTGGACCAGGAACTGGACATCAACC
GGCTGTCCGACTACGATGTGGACCATATCGTGCCTCAGAGCTTTCTGAAG
GACGACTCCATCGACAACAAGGTGCTGACCAGAAGCGACAAGAACCGGGG
CAAGAGCGACAACGTGCCCTCCGAAGAGGTCGTGAAGAAGATGAAGAACT
ACTGGCGGCAGCTGCTGAACGCCAAGCTGATTACCCAGAGAAAGTTCGAC
AATCTGACCAAGGCCGAGAGAGGCGGCCTGAGCGAACTGGATAAGGCCGG
CTTCATCAAGAGACAGCTGGTGGAAACCCGGCAGATCACAAAGCACGTGG
CACAGATCCTGGACTCCCGGATGAACACTAAGTACGACGAGAATGACAAG
CTGATCCGGGAAGTGAAAGTGATCACCCTGAAGTCCAAGCTGGTGTCCGA
TTTCCGGAAGGATTTCCAGTTTTACAAAGTGCGCGAGATCAACAACTACC
ACCACGCCCACGACGCCTACCTGAACGCCGTCGTGGGAACCGCCCTGATC
```

-continued

AAAAAGTACCCTAAGCTGGAAAGCGAGTTCGTGTACGGCGACTACAAGGT

GTACGACGTGCGGAAGATGATCGCCAAGAGCGAGCAGGAAATCGGCAAGG

CTACCGCCAAGTACTTCTTCTACAGCAACATCATGAACTTTTTCAAGACC

GAGATTACCCTGGCCAACGGCGAGATCCGGAAGCGGCCTCTGATCGAGAC

AAACGGCGAAACCGGGGAGATCGTGTGGGATAAGGGCCGGGATTTTGCCA

CCGTGCGGAAAGTGCTGAGCATGCCCCAAGTGAATATCGTGAAAAAGACC

GAGGTGCAGACAGGCGGCTTCAGCAAAGAGTCTATCCTGCCCAAGAGGAA

CAGCGATAAGCTGATCGCCAGAAAGAAGGACTGGGACCCTAAGAAGTACG

GCGGCTTCGACAGCCCCACCGTGGCCTATTCTGTGCTGGTGGTGGCCAAA

GTGGAAAAGGGCAAGTCCAAGAAACTGAAGAGTGTGAAAGAGCTGCTGGG

GATCACCATCATGGAAAGAAGCAGCTTCGAGAAGAATCCCATCGACTTTC

TGGAAGCCAAGGGCTACAAAGAAGTGAAAAAGGACCTGATCATCAAGCTG

CCTAAGTACTCCCTGTTCGAGCTGGAAAACGGCCGGAAGAGAATGCTGGC

CTCTGCCGGCGAACTGCAGAAGGGAAACGAACTGGCCCTGCCCTCCAAAT

ATGTGAACTTCCTGTACCTGGCCAGCCACTATGAGAAGCTGAAGGGCTCC

CCCGAGGATAATGAGCAGAAACAGCTGTTTGTGGAACAGCACAAGCACTA

CCTGGACGAGATCATCGAGCAGATCAGCGAGTTCTCCAAGAGAGTGATCC

TGGCCGACGCTAATCTGGACAAAGTGCTGTCCGCCTACAACAAGCACCGG

GATAAGCCCATCAGAGAGCAGGCCGAGAATATCATCCACCTGTTTACCCT

GACCAATCTGGGAGCCCCTGCCGCCTTCAAGTACTTTGACACCACCATCG

ACCGGAAGAGGTACACCAGCACCAAAGAGGTGCTGGACGCCACCCTGATC

CACCAGAGCATCACCGGCCTGTACGAGACACGGATCGACCTGTCTCAGCT

GGGAGGCGACAAAAGGCCGGCGGCCACGAAAAAGGCCGGCCAGGCAAAAA

AGAAAAAGtaa

30. Sp_del (175-307) (Hiroshi's prediction)
 (SEQ ID NO: 99)
ATGGCCCCAAAGAAGAAGCGGAAGGTCGGTATCCACGGAGTCCCAGCAGC

CGACAAGAAGTACAGCATCGGCCTGGACATCGGCACCAACTCTGTGGGCT

GGGCCGTGATCACCGACGAGTACAAGGTGCCCAGCAAGAAATTCAAGGTG

CTGGGCAACACCGACCGGCACAGCATCAAGAAGAACCTGATCGGAGCCCT

GCTGTTCGACAGCGGCGAAACAGCCGAGGCCACCCGGCTGAAGAGAACCG

CCAGAAGAAGATACACCAGACGGAAGAACCGGATCTGCTATCTGCAAGAG

ATCTTCAGCAACGAGATGGCCAAGGTGGACGACAGCTTCTTCCACAGACT

GGAAGAGTCCTTCCTGGTGGAAGAGGATAAGAAGCACGAGCGGCACCCCA

TCTTCGGCAACATCGTGGACGAGGTGGCCTACCACGAGAAGTACCCCACC

ATCTACCACCTGAGAAAGAAACTGGTGGACAGCACCGACAAGGCCGACCT

GCGGCTGATCTATCTGGCCCTGGCCCACATGATCAAGTTCCGGGGCCACT

TCCTGATCGAGGGCGACCTGGTGAACACCGAGATCACCAAGGCCCCCCTG

AGCGCCTCTATGATCAAGAGATACGACGAGCACCACCAGGACCTGACCCT

GCTGAAAGCTCTCGTGCGGCAGCAGCTGCCTGAGAAGTACAAAGAGATTT

TCTTCGACCAGAGCAAGAACGGCTACGCCGGCTACATTGACGGCGGAGCC

AGCCAGGAAGAGTTCTACAAGTTCATCAAGCCCATCCTGGAAAAGATGGA

CGGCACCGAGGAACTGCTCGTGAAGCTGAACAGAGAGGACCTGCTGCGGA

AGCAGCGGACCTTCGACAACGGCAGCATCCCCCACCAGATCCACCTGGGA

GAGCTGCACGCCATTCTGCGGCGGCAGGAAGATTTTTACCCATTCCTGAA

GGACAACCGGGAAAAGATCGAGAAGATCCTGACCTTCCGCATCCCCTACT

ACGTGGGCCCTCTGGCCAGGGGAAACAGCAGATTCGCCTGGATGACCAGA

AAGAGCGAGGAAACCATCACCCCCTGGAACTTCGAGGAAGTGGTGGACAA

GGGCGCTTCCGCCCAGAGCTTCATCGAGCGGATGACCAACTTCGATAAGA

ACCTGCCCAACGAGAAGGTGCTGCCCAAGCACAGCCTGCTGTACGAGTAC

TTCACCGTGTATAACGAGCTGACCAAAGTGAAATACGTGACCGAGGGAAT

GAGAAAGCCCGCCTTCCTGAGCGGCGAGCAGAAAAAGGCCATCGTGGACC

TGCTGTTCAAGACCAACCGGAAAGTGACCGTGAAGCAGCTGAAAGAGGAC

TACTTCAAGAAAATCGAGTGCTTCGACTCCGTGGAAATCTCCGGCGTGGA

AGATCGGTTCAACGCCTCCCTGGGCACATACCACGATCTGCTGAAAATTA

TCAAGGACAAGGACTTCCTGGACAATGAGGAAAACGAGGACATTCTGGAA

GATATCGTGCTGACCCTGACACTGTTTGAGGACAGAGAGATGATCGAGGA

ACGGCTGAAAACCTATGCCCACCTGTTCGACGACAAAGTGATGAAGCAGC

TGAAGCGGCGGAGATACACCGGCTGGGGCAGGCTGAGCCGGAAGCTGATC

AACGGCATCCGGGACAAGCAGTCCGGCAAGACAATCCTGGATTTCCTGAA

GTCCGACGGCTTCGCCAACAGAAACTTCATGCAGCTGATCCACGACGACA

GCCTGACCTTTAAAGAGGACATCCAGAAAGCCCAGGTGTCCGGCCAGGGC

GATAGCCTGCACGAGCACATTGCCAATCTGGCCGGCAGCCCCGCCATTAA

GAAGGGCATCCTGCAGACAGTGAAGGTGGTGGACGAGCTCGTGAAAGTGA

TGGGCCGGCACAAGCCCGAGAACATCGTGATCGAAATGGCCAGAGAGAAC

CAGACCACCCAGAAGGGACAGAAGAACAGCCGCGAGAGAATGAAGCGGAT

CGAAGAGGGCATCAAAGAGCTGGGCAGCCAGATCCTGAAAGAACACCCCG

TGGAAAACACCCAGCTGCAGAACGAGAAGCTGTACCTGTACTACCTGCAG

AATGGGCGGGATATGTACGTGGACCAGGAACTGGACATCAACCGGCTGTC

CGACTACGATGTGGACCATATCGTGCCTCAGAGCTTTCTGAAGGACGACT

CCATCGACAACAAGGTGCTGACCAGAAGCGACAAGAACCGGGGCAAGAGC

GACAACGTGCCCTCCGAAGAGGTCGTGAAGAAGATGAAGAACTACTGGCG

GCAGCTGCTGAACGCCAAGCTGATTACCCAGAGAAAGTTCGACAATCTGA

CCAAGGCCGAGAGAGGCGGCCTGAGCGAACTGGATAAGGCCGGCTTCATC

AAGAGACAGCTGGTGGAAACCCGGCAGATCACAAAGCACGTGGCACAGAT

CCTGGACTCCCGGATGAACACTAAGTACGACGAGAATGACAAGCTGATCC

GGGAAGTGAAAGTGATCACCCTGAAGTCCAAGCTGGTGTCCGATTTCCGG

AAGGATTTCCAGTTTTACAAAGTGCGCGAGATCAACAACTACCACCACGC

CCACGACGCCTACCTGAACGCCGTCGTGGGAACCGCCCTGATCAAAAAGT

ACCCTAAGCTGGAAAGCGAGTTCGTGTACGGCGACTACAAGGTGTACGAC

GTGCGGAAGATGATCGCCAAGAGCGAGCAGGAAATCGGCAAGGCTACCGC

CAAGTACTTCTTCTACAGCAACATCATGAACTTTTTCAAGACCGAGATTA

-continued

CCCTGGCCAACGGCGAGATCCGGAAGCGGCCTCTGATCGAGACAAACGGC
GAAACCGGGGAGATCGTGTGGGATAAGGGCCGGGATTTTGCCACCGTGCG
GAAAGTGCTGAGCATGCCCCAAGTGAATATCGTGAAAAAGACCGAGGTGC
AGACAGGCGGCTTCAGCAAAGAGTCTATCCTGCCCAAGAGGAACAGCGAT
AAGCTGATCGCCAGAAAGAAGGACTGGGACCCTAAGAAGTACGGCGGCTT
CGACAGCCCCACCGTGGCCTATTCTGTGCTGGTGGTGGCCAAAGTGGAAA
AGGGCAAGTCCAAGAAACTGAAGAGTGTGAAAGAGCTGCTGGGGATCACC
ATCATGGAAAGAAGCAGCTTCGAGAAGAATCCCATCGACTTTCTGGAAGC
CAAGGGCTACAAAGAAGTGAAAAAGGACCTGATCATCAAGCTGCCTAAGT
ACTCCCTGTTCGAGCTGGAAAACGGCCGGAAGAGAATGCTGGCCTCTGCC
GGCGAACTGCAGAAGGGAAACGAACTGGCCCTGCCCTCCAAATATGTGAA
CTTCCTGTACCTGGCCAGCCACTATGAGAAGCTGAAGGGCTCCCCCGAGG
ATAATGAGCAGAAACAGCTGTTTGTGGAACAGCACAAGCACTACCTGGAC
GAGATCATCGAGCAGATCAGCGAGTTCTCCAAGAGAGTGATCCTGGCCGA
CGCTAATCTGGACAAAGTGCTGTCCGCCTACAACAAGCACCGGGATAAGC
CCATCAGAGAGCAGGCCGAGAATATCATCCACCTGTTTACCCTGACCAAT
CTGGGAGCCCCTGCCGCCTTCAAGTACTTTGACACCACCATCGACCGGAA
GAGGTACACCAGCACCAAAGAGGTGCTGGACGCCACCCTGATCCACCAGA
GCATCACCGGCCTGTACGAGACACGGATCGACCTGTCTCAGCTGGGAGGC
GACAAAAGGCCGGCGGCCACGAAAAAGGCCGGCCAGGCAAAAAGAAAAA
Gtaa 31. Sp_del (1098-end)
(SEQ ID NO: 100)
ATGGCCCCAAAGAAGAAGCGGAAGGTCGGTATCCACGGAGTCCCAGCAGC
CGACAAGAAGTACAGCATCGGCCTGGACATCGGCACCAACTCTGTGGGCT
GGGCCGTGATCACCGACGAGTACAAGGTGCCCAGCAAGAAATTCAAGGTG
CTGGGCAACACCGACCGGCACAGCATCAAGAAGAACCTGATCGGAGCCCT
GCTGTTCGACAGCGGCGAAACAGCCGAGGCCACCCGGCTGAAGAGAACCG
CCAGAAGAAGATACACCAGACGGAAGAACCGGATCTGCTATCTGCAAGAG
ATCTTCAGCAACGAGATGGCCAAGGTGGACGACAGCTTCTTCCACAGACT
GGAAGAGTCCTTCCTGGTGGAAGAGGATAAGAAGCACGAGCGGCACCCCA
TCTTCGGCAACATCGTGGACGAGGTGGCCTACCACGAGAAGTACCCCACC
ATCTACCACCTGAGAAAGAAACTGGTGGACAGCACCGACAAGGCCGACCT
GCGGCTGATCTATCTGGCCCTGGCCCACATGATCAAGTTCCGGGGCCACT
TCCTGATCGAGGGCGACCTGAACCCCGACAACAGCGACGTGGACAAGCTG
TTCATCCAGCTGGTGCAGACCTACAACCAGCTGTTCGAGGAAAACCCCAT
CAACGCCAGCGGCGTGGACGCCAAGGCCATCCTGTCTGCCAGACTGAGCA
AGAGCAGACGGCTGGAAAATCTGATCGCCCAGCTGCCCGGCGAGAAGAAG
AATGGCCTGTTCGGAAACCTGATTGCCCTGAGCCTGGGCCTGACCCCCAA
CTTCAAGAGCAACTTCGACCTGGCCGAGGATGCCAAACTGCAGCTGAGCA
AGGACACCTACGACGACGACCTGGACAACCTGCTGGCCCAGATCGGCGAC -continued CAGTACGCCGACCTGTTTCTGGCCGCCAAGAACCTGTCCGACGCCATCCT
GCTGAGCGACATCCTGAGAGTGAACACCGAGATCACCAAGGCCCCCCTGA
GCGCCTCTATGATCAAGAGATACGACGAGCACCACCAGGACCTGACCCTG
CTGAAAGCTCTCGTGCGGCAGCAGCTGCCTGAGAAGTACAAAGAGATTTT
CTTCGACCAGAGCAAGAACGGCTACGCCGGCTACATTGACGGCGGAGCCA
GCCAGGAAGAGTTCTACAAGTTCATCAAGCCCATCCTGGAAAAGATGGAC
GGCACCGAGGAACTGCTCGTGAAGCTGAACAGAGAGGACCTGCTGCGGAA
GCAGCGGACCTTCGACAACGGCAGCATCCCCCACCAGATCCACCTGGGAG
AGCTGCACGCCATTCTGCGGCGGCAGGAAGATTTTTACCCATTCCTGAAG
GACAACCGGGAAAAGATCGAGAAGATCCTGACCTTCCGCATCCCCTACTA
CGTGGGCCCTCTGGCCAGGGGAAACAGCAGATTCGCCTGGATGACCAGAA
AGAGCGAGGAAACCATCACCCCCTGGAACTTCGAGGAAGTGGTGGACAAG
GGCGCTTCCGCCCAGAGCTTCATCGAGCGGATGACCAACTTCGATAAGAA
CCTGCCCAACGAGAAGGTGCTGCCCAAGCACAGCCTGCTGTACGAGTACT
TCACCGTGTATAACGAGCTGACCAAAGTGAAATACGTGACCGAGGGAATG
AGAAAGCCCGCCTTCCTGAGCGGCGAGCAGAAAAAGGCCATCGTGGACCT
GCTGTTCAAGACCAACCGGAAAGTGACCGTGAAGCAGCTGAAAGAGGACT
ACTTCAAGAAAATCGAGTGCTTCGACTCCGTGGAAATCTCCGGCGTGGAA
GATCGGTTCAACGCCTCCCTGGGCACATACCACGATCTGCTGAAAATTAT
CAAGGACAAGGACTTCCTGGACAATGAGGAAAACGAGGACATTCTGGAAG
ATATCGTGCTGACCCTGACACTGTTTGAGGACAGAGAGATGATCGAGGAA
CGGCTGAAAACCTATGCCCACCTGTTCGACGACAAAGTGATGAAGCAGCT
GAAGCGGCGGAGATACACCGGCTGGGGCAGGCTGAGCCGGAAGCTGATCA
ACGGCATCCGGGACAAGCAGTCCGGCAAGACAATCCTGGATTTCCTGAAG
TCCGACGGCTTCGCCAACAGAAACTTCATGCAGCTGATCCACGACGACAG
CCTGACCTTTAAAGAGGACATCCAGAAAGCCCAGGTGTCCGGCCAGGGCG
ATAGCCTGCACGAGCACATTGCCAATCTGGCCGGCAGCCCCGCCATTAAG
AAGGGCATCCTGCAGACAGTGAAGGTGGTGGACGAGCTCGTGAAAGTGAT
GGGCCGGCACAAGCCCGAGAACATCGTGATCGAAATGGCCAGAGAGAACC
AGACCACCCAGAAGGGACAGAAGAACAGCCGCGAGAGAATGAAGCGGATC
GAAGAGGGCATCAAAGAGCTGGGCAGCCAGATCCTGAAAGAACACCCCGT
GGAAAACACCCAGCTGCAGAACGAGAAGCTGTACCTGTACTACCTGCAGA
ATGGGCGGGATATGTACGTGGACCAGGAACTGGACATCAACCGGCTGTCC
GACTACGATGTGGACCATATCGTGCCTCAGAGCTTTCTGAAGGACGACTC
CATCGACAACAAGGTGCTGACCAGAAGCGACAAGAACCGGGGCAAGAGCG
ACAACGTGCCCTCCGAAGAGGTCGTGAAGAAGATGAAGAACTACTGGCGG
CAGCTGCTGAACGCCAAGCTGATTACCCAGAGAAAGTTCGACAATCTGAC
CAAGGCCGAGAGAGGCGGCCTGAGCGAACTGGATAAGGCCGGCTTCATCA
AGAGACAGCTGGTGGAAACCCGGCAGATCACAAAGCACGTGGCACAGATC
CTGGACTCCCGGATGAACACTAAGTACGACGAGAATGACAAGCTGATCCG
GGAAGTGAAAGTGATCACCCTGAAGTCCAAGCTGGTGTCCGATTTCCGGA -continued AGGATTTCCAGTTTTACAAAGTGCGCGAGATCAACAACTACCACCACGCC
CACGACGCCTACCTGAACGCCGTCGTGGGAACCGCCCTGATCAAAAAGTA
CCCTAAGCTGGAAAGCGAGTTCGTGTACGGCGACTACAAGGTGTACGACG
TGCGGAAGATGATCGCCAAGAGCGAGCAGGAAATCGGCAAGGCTACCGCC
AAGTACTTCTTCTACAGCAACATCATGAACTTTTTCAAGACCGAGATTAC
CCTGGCCAACGGCGAGATCCGGAAGCGGCCTCTGATCGAGACAAACGGCG
AAACCGGGGAGATCGTGTGGGATAAGGGCCGGGATTTTGCCACCGTGCGG
AAAGTGCTGAGCATGCCCCAAGTGAATATCGTGAAAAAGACCAAAAGGCC
GGCGGCCACGAAAAAGGCCGGCCAGGCAAAAAAGAAAAAGtaa 32. Sp_del(175-307)-(GGGGS)3 ("(GGGGS)3"
disclosed as SEQ ID NO: 9)
(SEQ ID NO: 101)
ATGGCCCCAAAGAAGAAGCGGAAGGTCGGTATCCACGGAGTCCCAGCAGC
CGACAAGAAGTACAGCATCGGCCTGGACATCGGCACCAACTCTGTGGGCT
GGGCCGTGATCACCGACGAGTACAAGGTGCCCAGCAAGAAATTCAAGGTG
CTGGGCAACACCGACCGGCACAGCATCAAGAAGAACCTGATCGGAGCCCT
GCTGTTCGACAGCGGCGAAACAGCCGAGGCCACCCGGCTGAAGAGAACCG
CCAGAAGAAGATACACCAGACGGAAGAACCGGATCTGCTATCTGCAAGAG
ATCTTCAGCAACGAGATGGCCAAGGTGGACGACAGCTTCTTCCACAGACT
GGAAGAGTCCTTCCTGGTGGAAGAGGATAAGAAGCACGAGCGGCACCCCA
TCTTCGGCAACATCGTGGACGAGGTGGCCTACCACGAGAAGTACCCCACC
ATCTACCACCTGAGAAAGAAACTGGTGGACAGCACCGACAAGGCCGACCT
GCGGCTGATCTATCTGGCCCTGGCCCACATGATCAAGTTCCGGGGCCACT
TCCTGATCGAGGGCGACCTGGGTGGaGGTGGCtcgGGTGGaGGTGGCtcg
GGTGGaGGTGGCtcgGTGAACACCGAGATCACCAAGGCCCCCCTGAGCGC
CTCTATGATCAAGAGATACGACGAGCACCACCAGGACCTGACCCTGCTGA
AGCTCTCGTGCGGCAGCAGCTGCCTGAGAAGTACAAAGAGATTTTCTTC
GACCAGAGCAAGAACGGCTACGCCGGCTACATTGACGGCGGAGCCAGCCA
GGAAGAGTTCTACAAGTTCATCAAGCCCATCCTGGAAAAGATGGACGGCA
CCGAGGAACTGCTCGTGAAGCTGAACAGAGAGGACCTGCTGCGGAAGCAG
CGGACCTTCGACAACGGCAGCATCCCCCACCAGATCCACCTGGGAGAGCT
GCACGCCATTCTGCGGCGGCAGGAAGATTTTTACCCATTCCTGAAGGACA
ACCGGGAAAAGATCGAGAAGATCCTGACCTTCCGCATCCCCTACTACGTG
GGCCCTCTGGCCAGGGGAAACAGCAGATTCGCCTGGATGACCAGAAAGAG
CGAGGAAACCATCACCCCCTGGAACTTCGAGGAAGTGGTGGACAAGGGCG
CTTCCGCCCAGAGCTTCATCGAGCGGATGACCAACTTCGATAAGAACCTG
CCCAACGAGAAGGTGCTGCCCAAGCACAGCCTGCTGTACGAGTACTTCAC
CGTGTATAACGAGCTGACCAAAGTGAAATACGTGACCGAGGGAATGAGAA
AGCCCGCCTTCCTGAGCGGCGAGCAGAAAAAGGCCATCGTGGACCTGCTG
TTCAAGACCAACCGGAAAGTGACCGTGAAGCAGCTGAAAGAGGACTACTT
CAAGAAAATCGAGTGCTTCGACTCCGTGGAAATCTCCGGCGTGGAAGATC
GGTTCAACGCCTCCCTGGGCACATACCACGATCTGCTGAAAATTATCAAG GACAAGGACTTCCTGGACAATGAGGAAAACGAGGACATTCTGGAAGATAT
CGTGCTGACCCTGACACTGTTTGAGGACAGAGAGATGATCGAGGAACGGC
TGAAAACCTATGCCCACCTGTTCGACGACAAAGTGATGAAGCAGCTGAAG
CGGCGGAGATACACCGGCTGGGGCAGGCTGAGCCGGAAGCTGATCAACGG
CATCCGGGACAAGCAGTCCGGCAAGACAATCCTGGATTTCCTGAAGTCCG
ACGGCTTCGCCAACAGAAACTTCATGCAGCTGATCCACGACGACAGCCTG
ACCTTTAAAGAGGACATCCAGAAAGCCCAGGTGTCCGGCCAGGGCGATAG
CCTGCACGAGCACATTGCCAATCTGGCCGGCAGCCCCGCCATTAAGAAGG
GCATCCTGCAGACAGTGAAGGTGGTGGACGAGCTCGTGAAAGTGATGGGC
CGGCACAAGCCCGAGAACATCGTGATCGAAATGGCCAGAGAGAACCAGAC
CACCCAGAAGGGACAGAAGAACAGCCGCGAGAGAATGAAGCGGATCGAAG
AGGGCATCAAAGAGCTGGGCAGCCAGATCCTGAAAGAACACCCCGTGGAA
AACACCCAGCTGCAGAACGAGAAGCTGTACCTGTACTACCTGCAGAATGG
GCGGGATATGTACGTGGACCAGGAACTGGACATCAACCGGCTGTCCGACT
ACGATGTGGACCATATCGTGCCTCAGAGCTTTCTGAAGGACGACTCCATC
GACAACAAGGTGCTGACCAGAAGCGACAAGAACCGGGGCAAGAGCGACAA
CGTGCCCTCCGAAGAGGTCGTGAAGAAGATGAAGAACTACTGGCGGCAGC
TGCTGAACGCCAAGCTGATTACCCAGAGAAAGTTCGACAATCTGACCAAG
GCCGAGAGAGGCGGCCTGAGCGAACTGGATAAGGCCGGCTTCATCAAGAG
ACAGCTGGTGGAAACCCGGCAGATCACAAAGCACGTGGCACAGATCCTGG
ACTCCCGGATGAACACTAAGTACGACGAGAATGACAAGCTGATCCGGGAA
GTGAAAGTGATCACCCTGAAGTCCAAGCTGGTGTCCGATTTCCGGAAGGA
TTTCCAGTTTTACAAAGTGCGCGAGATCAACAACTACCACCACGCCCACG
ACGCCTACCTGAACGCCGTCGTGGGAACCGCCCTGATCAAAAAGTACCCT
AAGCTGGAAAGCGAGTTCGTGTACGGCGACTACAAGGTGTACGACGTGCG
GAAGATGATCGCCAAGAGCGAGCAGGAAATCGGCAAGGCTACCGCCAAGT
ACTTCTTCTACAGCAACATCATGAACTTTTTCAAGACCGAGATTACCCTG
GCCAACGGCGAGATCCGGAAGCGGCCTCTGATCGAGACAAACGGCGAAAC
CGGGGAGATCGTGTGGGATAAGGGCCGGGATTTTGCCACCGTGCGGAAAG
TGCTGAGCATGCCCCAAGTGAATATCGTGAAAAAGACCGAGGTGCAGACA
GGCGGCTTCAGCAAAGAGTCTATCCTGCCCAAGAGGAACAGCGATAAGCT
GATCGCCAGAAAGAAGGACTGGGACCCTAAGAAGTACGGCGGCTTCGACA
GCCCCACCGTGGCCTATTCTGTGCTGGTGGTGGCCAAAGTGGAAAAGGGC
AAGTCCAAGAAACTGAAGAGTGTGAAAGAGCTGCTGGGGATCACCATCAT
GGAAAGAAGCAGCTTCGAAGAATCCCATCGACTTTCTGGAAGCCAAGG
GCTACAAAGAAGTGAAAAAGGACCTGATCATCAAGCTGCCTAAGTACTCC
CTGTTCGAGCTGGAAAACGGCCGGAAGAGAATGCTGGCCTCTGCCGGCGA
ACTGCAGAAGGGAAACGAACTGGCCCTGCCCTCCAAATATGTGAACTTCC
TGTACCTGGCCAGCCACTATGAGAAGCTGAAGGGCTCCCCCGAGGATAAT
GAGCAGAAACAGCTGTTTGTGGAACAGCACAAGCACTACCTGGACGAGAT -continued

CATCGAGCAGATCAGCGAGTTCTCCAAGAGAGTGATCCTGGCCGACGCTA

ATCTGGACAAAGTGCTGTCCGCCTACAACAAGCACCGGGATAAGCCCATC

AGAGAGCAGGCCGAGAATATCATCCACCTGTTTACCCTGACCAATCTGGG

AGCCCCTGCCGCCTTCAAGTACTTTGACACCACCATCGACCGGAAGAGGT

ACACCAGCACCAAAGAGGTGCTGGACGCCACCCTGATCCACCAGAGCATC

ACCGGCCTGTACGAGACACGGATCGACCTGTCTCAGCTGGGAGGCGACAA

AAGGCCGGCGGCCACGAAAAAGGCCGGCCAGGCAAAAAAGAAAAAGtaa

33. Sp_del (175-307)-(GGGGS)6 ("(GGGGS)6"
disclosed as SEQ ID NO: 10)

(SEQ ID NO: 102)

ATGGCCCCAAAGAAGAAGCGGAAGGTCGGTATCCACGGAGTCCCAGCAGC

CGACAAGAAGTACAGCATCGGCCTGGACATCGGCACCAACTCTGTGGGCT

GGGCCGTGATCACCGACGAGTACAAGGTGCCCAGCAAGAAATTCAAGGTG

CTGGGCAACACCGACCGGCACAGCATCAAGAAGAACCTGATCGGAGCCCT

GCTGTTCGACAGCGGCGAAACAGCCGAGGCCACCCGGCTGAAGAGAACCG

CCAGAAGAAGATACACCAGACGGAAGAACCGGATCTGCTATCTGCAAGAG

ATCTTCAGCAACGAGATGGCCAAGGTGGACGACAGCTTCTTCCACAGACT

GGAAGAGTCCTTCCTGGTGGAAGAGGATAAGAAGCACGAGCGGCACCCCA

TCTTCGGCAACATCGTGGACGAGGTGGCCTACCACGAGAAGTACCCCACC

ATCTACCACCTGAGAAAGAAACTGGTGGACAGCACCGACAAGGCCGACCT

GCGGCTGATCTATCTGGCCCTGGCCCACATGATCAAGTTCCGGGGCCACT

TCCTGATCGAGGGCGACCTGGGTGGaGGTGGCtcgGGTGGaGGTGGCtcg

GGTGGaGGTGGCtcgGGTGGaGGTGGCtcgGGTGGaGGTGGCtcgGGTGG aGGTGGCtcgGTGAACACCGAGATCACCAAGGCCCCCCTGAGCGCCTCTA

TGATCAAGAGATACGACGAGCACCACCAGGACCTGACCCTGCTGAAAGCT

CTCGTGCGGCAGCAGCTGCCTGAGAAGTACAAAGAGATTTTCTTCGACCA

GAGCAAGAACGGCTACGCCGGCTACATTGACGGCGGAGCCAGCCAGGAAG

AGTTCTACAAGTTCATCAAGCCCATCCTGGAAAAGATGGACGGCACCGAG

GAACTGCTCGTGAAGCTGAACAGAGAGGACCTGCTGCGGAAGCAGCGGAC

CTTCGACAACGGCAGCATCCCCCACCAGATCCACCTGGGAGAGCTGCACG

CCATTCTGCGGCGGCAGGAAGATTTTTACCCATTCCTGAAGGACAACCGG

GAAAAGATCGAGAAGATCCTGACCTTCCGCATCCCCTACTACGTGGGCCC

TCTGGCCAGGGGAAACAGCAGATTCGCCTGGATGACCAGAAAGAGCGAGG

AAACCATCACCCCCTGGAACTTCGAGGAAGTGGTGGACAAGGGCGCTTCC

GCCCAGAGCTTCATCGAGCGGATGACCAACTTCGATAAGAACCTGCCCAA

CGAGAAGGTGCTGCCCAAGCACAGCCTGCTGTACGAGTACTTCACCGTGT

ATAACGAGCTGACCAAAGTGAAATACGTGACCGAGGGAATGAGAAAGCCC

GCCTTCCTGAGCGGCGAGCAGAAAAAGGCCATCGTGGACCTGCTGTTCAA

GACCAACCGGAAAGTGACCGTGAAGCAGCTGAAAGAGGACTACTTCAAGA

AAATCGAGTGCTTCGACTCCGTGGAAATCTCCGGCGTGGAAGATCGGTTC

AACGCCTCCCTGGGCACATACCACGATCTGCTGAAAATTATCAAGGACAA

GGACTTCCTGGACAATGAGGAAAACGAGGACATTCTGGAAGATATCGTGC

-continued

TGACCCTGACACTGTTTGAGGACAGAGAGATGATCGAGGAACGGCTGAAA

ACCTATGCCCACCTGTTCGACGACAAAGTGATGAAGCAGCTGAAGCGGCG

GAGATACACCGGCTGGGGCAGGCTGAGCCGGAAGCTGATCAACGGCATCC

GGGACAAGCAGTCCGGCAAGACAATCCTGGATTTCCTGAAGTCCGACGGC

TTCGCCAACAGAAACTTCATGCAGCTGATCCACGACGACAGCCTGACCTT

TAAAGAGGACATCCAGAAAGCCCAGGTGTCCGGCCAGGGCGATAGCCTGC

ACGAGCACATTGCCAATCTGGCCGGCAGCCCCGCCATTAAGAAGGGCATC

CTGCAGACAGTGAAGGTGGTGGACGAGCTCGTGAAAGTGATGGGCCGGCA

CAAGCCCGAGAACATCGTGATCGAAATGGCCAGAGAGAACCAGACCACCC

AGAAGGGACAGAAGAACAGCCGCGAGAGAATGAAGCGGATCGAAGAGGGC

ATCAAAGAGCTGGGCAGCCAGATCCTGAAAGAACACCCCGTGGAAAACAC

CCAGCTGCAGAACGAGAAGCTGTACCTGTACTACCTGCAGAATGGGCGGG

ATATGTACGTGGACCAGGAACTGGACATCAACCGGCTGTCCGACTACGAT

GTGGACCATATCGTGCCTCAGAGCTTTCTGAAGGACGACTCCATCGACAA

CAAGGTGCTGACCAGAAGCGACAAGAACCGGGGCAAGAGCGACAACGTGC

CCTCCGAAGAGGTCGTGAAGAAGATGAAGAACTACTGGCGGCAGCTGCTG

AACGCCAAGCTGATTACCCAGAGAAAGTTCGACAATCTGACCAAGGCCGA

GAGAGGCGGCCTGAGCGAACTGGATAAGGCCGGCTTCATCAAGAGACAGC

TGGTGGAAACCCGGCAGATCACAAAGCACGTGGCACAGATCCTGGACTCC

CGGATGAACACTAAGTACGACGAGAATGACAAGCTGATCCGGGAAGTGAA

AGTGATCACCCTGAAGTCCAAGCTGGTGTCCGATTTCCGGAAGGATTTCC

AGTTTTACAAAGTGCGCGAGATCAACAACTACCACCACGCCCACGACGCC

TACCTGAACGCCGTCGTGGGAACCGCCCTGATCAAAAAGTACCCTAAGCT

GGAAAGCGAGTTCGTGTACGGCGACTACAAGGTGTACGACGTGCGGAAGA

TGATCGCCAAGAGCGAGCAGGAAATCGGCAAGGCTACCGCCAAGTACTTC

TTCTACAGCAACATCATGAACTTTTTCAAGACCGAGATTACCCTGGCCAA

CGGCGAGATCCGGAAGCGGCCTCTGATCGAGACAAACGGCGAAACCGGGG

AGATCGTGTGGGATAAGGGCCGGGATTTTGCCACCGTGCGGAAAGTGCTG

AGCATGCCCCAAGTGAATATCGTGAAAAAGACCGAGGTGCAGACAGGCGG

CTTCAGCAAAGAGTCTATCCTGCCCAAGAGGAACAGCGATAAGCTGATCG

CCAGAAAGAAGGACTGGGACCCTAAGAAGTACGGCGGCTTCGACAGCCCC

ACCGTGGCCTATTCTGTGCTGGTGGTGGCCAAAGTGGAAAAGGGCAAGTC

CAAGAAACTGAAGAGTGTGAAAGAGCTGCTGGGGATCACCATCATGGAAA

GAAGCAGCTTCGAGAAGAATCCCATCGACTTTCTGGAAGCCAAGGGCTAC

AAAGAAGTGAAAAAGGACCTGATCATCAAGCTGCCTAAGTACTCCCTGTT

CGAGCTGGAAAACGGCCGGAAGAGAATGCTGGCCTCTGCCGGCGAACTGC

AGAAGGGAAACGAACTGGCCCTGCCCTCCAAATATGTGAACTTCCTGTAC

CTGGCCAGCCACTATGAGAAGCTGAAGGGCTCCCCCGAGGATAATGAGCA

GAAACAGCTGTTTGTGGAACAGCACAAGCACTACCTGGACGAGATCATCG

AGCAGATCAGCGAGTTCTCCAAGAGAGTGATCCTGGCCGACGCTAATCTG

GACAAAGTGCTGTCCGCCTACAACAAGCACCGGGATAAGCCCATCAGAGA

GCAGGCCGAGAATATCATCCACCTGTTTACCCTGACCAATCTGGGAGCCC
CTGCCGCCTTCAAGTACTTTGACACCACCATCGACCGGAAGAGGTACACC
AGCACCAAAGAGGTGCTGGACGCCACCCTGATCCACCAGAGCATCACCGG
CCTGTACGAGACACGGATCGACCTGTCTCAGCTGGGAGGCGACAAAAGGC
CGGCGGCCACGAAAAAGGCCGGCCAGGCAAAAAAGAAAAAGtaa 34. Sp_del (175-307)-(GGGGS)9 ("(GGGGS)9"
disclosed as SEQ ID NO: 11)

(SEQ ID NO: 103)
ATGGCCCCAAAGAAGAAGCGGAAGGTCGGTATCCACGGAGTCCCAGCAGC
CGACAAGAAGTACAGCATCGGCCTGGACATCGGCACCAACTCTGTGGGCT
GGGCCGTGATCACCGACGAGTACAAGGTGCCCAGCAAGAAATTCAAGGTG
CTGGGCAACACCGACCGGCACAGCATCAAGAAGAACCTGATCGGAGCCCT
GCTGTTCGACAGCGGCGAAACAGCCGAGGCCACCCGGCTGAAGAGAACCG
CCAGAAGAAGATACACCAGACGGAAGAACCGGATCTGCTATCTGCAAGAG
ATCTTCAGCAACGAGATGGCCAAGGTGGACGACAGCTTCTTCCACAGACT
GGAAGAGTCCTTCCTGGTGGAAGAGGATAAGAAGCACGAGCGGCACCCCA
TCTTCGGCAACATCGTGGACGAGGTGGCCTACCACGAGAAGTACCCCACC
ATCTACCACCTGAGAAAGAAACTGGTGGACAGCACCGACAAGGCCGACCT
GCGGCTGATCTATCTGGCCCTGGCCCACATGATCAAGTTCCGGGGCCACT
TCCTGATCGAGGGCGACCTGGGTGGaGGTGGCtcgGGTGGaGGTGGCtcg
GGTGGaGGTGGCtcgGGTGGaGGTGGCtcgGGTGGaGGTGGCtcgGGTGG
aGGTGGCtcgGGTGGaGGTGGCtcgGGTGGaGGTGGCtcgGGTGGaGGTG
GCtcgGTGAACACCGAGATCACCAAGGCCCCCCTGAGCGCCTCTATGATC
AAGAGATACGACGAGCACCACCAGGACCTGACCCTGCTGAAAGCTCTCGT
GCGGCAGCAGCTGCCTGAGAAGTACAAAGAGATTTTCTTCGACCAGAGCA
AGAACGGCTACGCCGGCTACATTGACGGCGGAGCCAGCCAGGAAGAGTTC
TACAAGTTCATCAAGCCCATCCTGGAAAAGATGGACGGCACCGAGGAACT
GCTCGTGAAGCTGAACAGAGAGGACCTGCTGCGGAAGCAGCGGACCTTCG
ACAACGGCAGCATCCCCCACCAGATCCACCTGGGAGAGCTGCACGCCATT
CTGCGGCGGCAGGAAGATTTTTACCCATTCCTGAAGGACAACCGGGAAAA
GATCGAGAAGATCCTGACCTTCCGCATCCCCTACTACGTGGGCCCTCTGG
CCAGGGGAAACAGCAGATTCGCCTGGATGACCAGAAAGAGCGAGGAAACC
ATCACCCCCTGGAACTTCGAGGAAGTGGTGGACAAGGGCGCTTCCGCCCA
GAGCTTCATCGAGCGGATGACCAACTTCGATAAGAACCTGCCCAACGAGA
AGGTGCTGCCCAAGCACAGCCTGCTGTACGAGTACTTCACCGTGTATAAC
GAGCTGACCAAAGTGAAATACGTGACCGAGGGAATGAGAAAGCCCGCCTT
CCTGAGCGGCGAGCAGAAAAAGGCCATCGTGGACCTGCTGTTCAAGACCA
ACCGGAAAGTGACCGTGAAGCAGCTGAAAGAGGACTACTTCAAGAAAATC
GAGTGCTTCGACTCCGTGGAAATCTCCGGCGTGGAAGATCGGTTCAACGC
CTCCCTGGGCACATACCACGATCTGCTGAAAATTATCAAGGACAAGGACT
TCCTGGACAATGAGGAAAACGAGGACATTCTGGAAGATATCGTGCTGACC
CTGACACTGTTTGAGGACAGAGAGATGATCGAGGAACGGCTGAAAACCTA TGCCCACCTGTTCGACGACAAAGTGATGAAGCAGCTGAAGCGGCGGAGAT
ACACCGGCTGGGGCAGGCTGAGCCGGAAGCTGATCAACGGCATCCGGGAC
AAGCAGTCCGGCAAGACAATCCTGGATTTCCTGAAGTCCGACGGCTTCGC
CAACAGAAACTTCATGCAGCTGATCCACGACGACAGCCTGACCTTTAAAG
AGGACATCCAGAAAGCCCAGGTGTCCGGCCAGGGCGATAGCCTGCACGAG
CACATTGCCAATCTGGCCGGCAGCCCCGCCATTAAGAAGGGCATCCTGCA
GACAGTGAAGGTGGTGGACGAGCTCGTGAAAGTGATGGGCCGGCACAAGC
CCGAGAACATCGTGATCGAAATGGCCAGAGAGAACCAGACCACCCAGAAG
GGACAGAAGAACAGCCGCGAGAGAATGAAGCGGATCGAAGAGGGCATCAA
AGAGCTGGGCAGCCAGATCCTGAAAGAACACCCCGTGGAAAACACCCAGC
TGCAGAACGAGAAGCTGTACCTGTACTACCTGCAGAATGGGCGGGATATG
TACGTGGACCAGGAACTGGACATCAACCGGCTGTCCGACTACGATGTGGA
CCATATCGTGCCTCAGAGCTTTCTGAAGGACGACTCCATCGACAACAAGG
TGCTGACCAGAAGCGACAAGAACCGGGGCAAGAGCGACAACGTGCCCTCC
GAAGAGGTCGTGAAGAAGATGAAGAACTACTGGCGGCAGCTGCTGAACGC
CAAGCTGATTACCCAGAGAAAGTTCGACAATCTGACCAAGGCCGAGAGAG
GCGGCCTGAGCGAACTGGATAAGGCCGGCTTCATCAAGAGACAGCTGGTG
GAAACCCGGCAGATCACAAAGCACGTGGCACAGATCCTGGACTCCCGGAT
GAACACTAAGTACGACGAGAATGACAAGCTGATCCGGGAAGTGAAAGTGA
TCACCCTGAAGTCCAAGCTGGTGTCCGATTTCCGGAAGGATTTCCAGTTT
TACAAAGTGCGCGAGATCAACAACTACCACCACGCCCACGACGCCTACCT
GAACGCCGTCGTGGGAACCGCCCTGATCAAAAAGTACCCTAAGCTGGAAA
GCGAGTTCGTGTACGGCGACTACAAGGTGTACGACGTGCGGAAGATGATC
GCCAAGAGCGAGCAGGAAATCGGCAAGGCTACCGCCAAGTACTTCTTCTA
CAGCAACATCATGAACTTTTTCAAGACCGAGATTACCCTGGCCAACGGCG
AGATCCGGAAGCGGCCTCTGATCGAGACAAACGGCGAAACCGGGGAGATC
GTGTGGGATAAGGGCCGGGATTTTGCCACCGTGCGGAAAGTGCTGAGCAT
GCCCCAAGTGAATATCGTGAAAAAGACCGAGGTGCAGACAGGCGGCTTCA
GCAAAGAGTCTATCCTGCCCAAGAGGAACAGCGATAAGCTGATCGCCAGA
AAGAAGGACTGGGACCCTAAGAAGTACGGCGGCTTCGACAGCCCCACCGT
GGCCTATTCTGTGCTGGTGGTGGCCAAAGTGGAAAAGGGCAAGTCCAAGA
AACTGAAGAGTGTGAAAGAGCTGCTGGGGATCACCATCATGGAAAGAAGC
AGCTTCGAAGAGAATCCCATCGACTTTCTGGAAGCCAAGGGCTACAAAGA
AGTGAAAAAGGACCTGATCATCAAGCTGCCTAAGTACTCCCTGTTCGAGC
TGGAAAACGGCCGGAAGAGAATGCTGGCCTCTGCCGGCGAACTGCAGAAG
GGAAACGAACTGGCCCTGCCCTCCAAATATGTGAACTTCCTGTACCTGGC
CAGCCACTATGAGAAGCTGAAGGGCTCCCCCGAGGATAATGAGCAGAAAC
AGCTGTTTGTGGAACAGCACAAGCACTACCTGGACGAGATCATCGAGCAG
ATCAGCGAGTTCTCCAAGAGAGTGATCCTGGCCGACGCTAATCTGGACAA
AGTGCTGTCCGCCTACAACAAGCACCGGGATAAGCCCATCAGAGAGCAGG

```
CCGAGAATATCATCCACCTGTTTACCCTGACCAATCTGGGAGCCCCTGCC
GCCTTCAAGTACTTTGACACCACCATCGACCGGAAGAGGTACACCAGCAC
CAAAGAGGTGCTGGACGCCACCCTGATCCACCAGAGCATCACCGGCCTGT
ACGAGACACGGATCGACCTGTCTCAGCTGGGAGGCGACAAAAGGCCGGCG
GCCACGAAAAAGGCCGGCCAGGCAAAAAGAAAAAGtaa
```

35. Sp_del (175-307)-(GGGGS)12 ("(GGGGS)12"
disclosed as SEQ ID NO: 12)

(SEQ ID NO: 104)
```
ATGGCCCCAAAGAAGAAGCGGAAGGTCGGTATCCACGGAGTCCCAGCAGC
CGACAAGAAGTACAGCATCGGCCTGGACATCGGCACCAACTCTGTGGGCT
GGGCCGTGATCACCGACGAGTACAAGGTGCCCAGCAAGAAATTCAAGGTG
CTGGGCAACACCGACCGGCACAGCATCAAGAAGAACCTGATCGGAGCCCT
GCTGTTCGACAGCGGCGAAACAGCCGAGGCCACCCGGCTGAAGAGAACCG
CCAGAAGAAGATACACCAGACGGAAGAACCGGATCTGCTATCTGCAAGAG
ATCTTCAGCAACGAGATGGCCAAGGTGGACGACAGCTTCTTCCACAGACT
GGAAGAGTCCTTCCTGGTGGAAGAGGATAAGAAGCACGAGCGGCACCCCA
TCTTCGGCAACATCGTGGACGAGGTGGCCTACCACGAGAAGTACCCCACC
ATCTACCACCTGAGAAAGAAACTGGTGGACAGCACCGACAAGGCCGACCT
GCGGCTGATCTATCTGGCCCTGGCCCACATGATCAAGTTCCGGGGCCACT
TCCTGATCGAGGGCGACCTGGGTGGaGGTGGttcgGGTGGCGGTGGCtcg
GGTGGaGGTGGatcgGGTGGCGGTGGttcgGGTGGaGGTGGCtcgGGcGG
aGGTGGatcgGGTGGCGGTGGCtcgGGTGGaGGTGGCtcgGGTGGaGGTG
GCtcgGGTGGCGGTGGatcgGGTGGaGGTGGatcgGGTGGaGGTGGttcg
GTGAACACCGAGATCACCAAGGCCCCCCTGAGCGCCTCTATGATCAAGAG
ATACGACGAGCACCACCAGGACCTGACCCTGCTGAAAGCTCTCGTGCGGC
AGCAGCTGCCTGAGAAGTACAAAGAGATTTTCTTCGACCAGAGCAAGAAC
GGCTACGCCGGCTACATTGACGGCGGAGCCAGCCAGGAAGAGTTCTACAA
GTTCATCAAGCCCATCCTGGAAAAGATGGACGGCACCGAGGAACTGCTCG
TGAAGCTGAACAGAGAGGACCTGCTGCGGAAGCAGCGGACCTTCGACAAC
GGCAGCATCCCCCACCAGATCCACCTGGGAGAGCTGCACGCCATTCTGCG
GCGGCAGGAAGATTTTTACCCATTCCTGAAGGACAACCGGGAAAAGATCG
AGAAGATCCTGACCTTCCGCATCCCCTACTACGTGGGCCCTCTGGCCAGG
GGAAACAGCAGATTCGCCTGGATGACCAGAAAGAGCGAGGAAACCATCAC
CCCCTGGAACTTCGAGGAAGTGGTGGACAAGGGCGCTTCCGCCCAGAGCT
TCATCGAGCGGATGACCAACTTCGATAAGAACCTGCCCAACGAGAAGGTG
CTGCCCAAGCACAGCCTGCTGTACGAGTACTTCACCGTGTATAACGAGCT
GACCAAAGTGAAATACGTGACCGAGGGAATGAGAAAGCCCGCCTTCCTGA
GCGGCGAGCAGAAAAAGGCCATCGTGGACCTGCTGTTCAAGACCAACCGG
AAAGTGACCGTGAAGCAGCTGAAAGAGGACTACTTCAAGAAAATCGAGTG
CTTCGACTCCGTGGAAATCTCCGGCGTGGAAGATCGGTTCAACGCCTCCC
TGGGCACATACCACGATCTGCTGAAAATTATCAAGGACAAGGACTTCCTG
GACAATGAGGAAAACGAGGACATTCTGGAAGATATCGTGCTGACCCTGAC
```

```
ACTGTTTGAGGACAGAGAGATGATCGAGGAACGGCTGAAAACCTATGCCC
ACCTGTTCGACGACAAAGTGATGAAGCAGCTGAAGCGGCGGAGATACACC
GGCTGGGGCAGGCTGAGCCGGAAGCTGATCAACGGCATCCGGGACAAGCA
GTCCGGCAAGACAATCCTGGATTTCCTGAAGTCCGACGGCTTCGCCAACA
GAAACTTCATGCAGCTGATCCACGACGACAGCCTGACCTTTAAAGAGGAC
ATCCAGAAAGCCCAGGTGTCCGGCCAGGGCGATAGCCTGCACGAGCACAT
TGCCAATCTGGCCGGCAGCCCCGCCATTAAGAAGGGCATCCTGCAGACAG
TGAAGGTGGTGGACGAGCTCGTGAAAGTGATGGGCCGGCACAAGCCCGAG
AACATCGTGATCGAAATGGCCAGAGAGAACCAGACCACCCAGAAGGGACA
GAAGAACAGCCGCGAGAGAATGAAGCGGATCGAAGAGGGCATCAAAGAGC
TGGGCAGCCAGATCCTGAAAGAACACCCCGTGGAAAACACCCAGCTGCAG
AACGAGAAGCTGTACCTGTACTACCTGCAGAATGGGCGGGATATGTACGT
GGACCAGGAACTGGACATCAACCGGCTGTCCGACTACGATGTGGACCATA
TCGTGCCTCAGAGCTTTCTGAAGGACGACTCCATCGACAACAAGGTGCTG
ACCAGAAGCGACAAGAACCGGGGCAAGAGCGACAACGTGCCCTCCGAAGA
GGTCGTGAAGAAGATGAAGAACTACTGGCGGCAGCTGCTGAACGCCAAGC
TGATTACCCAGAGAAAGTTCGACAATCTGACCAAGGCCGAGAGAGGCGGC
CTGAGCGAACTGGATAAGGCCGGCTTCATCAAGAGACAGCTGGTGGAAAC
CCGGCAGATCACAAAGCACGTGGCACAGATCCTGGACTCCCGGATGAACA
CTAAGTACGACGAGAATGACAAGCTGATCCGGGAAGTGAAAGTGATCACC
CTGAAGTCCAAGCTGGTGTCCGATTTCCGGAAGGATTTCCAGTTTTACAA
AGTGCGCGAGATCAACAACTACCACCACGCCCACGACGCCTACCTGAACG
CCGTCGTGGGAACCGCCCTGATCAAAAAGTACCCTAAGCTGGAAAGCGAG
TTCGTGTACGGCGACTACAAGGTGTACGACGTGCGGAAGATGATCGCCAA
GAGCGAGCAGGAAATCGGCAAGGCTACCGCCAAGTACTTCTTCTACAGCA
ACATCATGAACTTTTTCAAGACCGAGATTACCCTGGCCAACGGCGAGATC
CGGAAGCGGCCTCTGATCGAGACAAACGGCGAAACCGGGGAGATCGTGTG
GGATAAGGGCCGGGATTTTGCCACCGTGCGGAAAGTGCTGAGCATGCCCC
AAGTGAATATCGTGAAAAAGACCGAGGTGCAGACAGGCGGCTTCAGCAAA
GAGTCTATCCTGCCCAAGAGGAACAGCGATAAGCTGATCGCCAGAAAGAA
GGACTGGGACCCTAAGAAGTACGGCGGCTTCGACAGCCCCACCGTGGCCT
ATTCTGTGCTGGTGGTGGCCAAAGTGGAAAAGGGCAAGTCCAAGAAACTG
AAGAGTGTGAAAGAGCTGCTGGGGATCACCATCATGGAAAGAAGCAGCTT
CGAGAAGAATCCCATCGACTTTCTGGAAGCCAAGGGCTACAAAGAAGTGA
AAAAGGACCTGATCATCAAGCTGCCTAAGTACTCCCTGTTCGAGCTGGAA
AACGGCCGGAAGAGAATGCTGGCCTCTGCCGGCGAACTGCAGAAGGGAAA
CGAACTGGCCCTGCCCTCCAAATATGTGAACTTCCTGTACCTGGCCAGCC
ACTATGAGAAGCTGAAGGGCTCCCCCGAGGATAATGAGCAGAAACAGCTG
TTTGTGGAACAGCACAAGCACTACCTGGACGAGATCATCGAGCAGATCAG
CGAGTTCTCCAAGAGAGTGATCCTGGCCGACGCTAATCTGGACAAAGTGC
TGTCCGCCTACAACAAGCACCGGGATAAGCCCATCAGAGAGCAGGCCGAG
```

```
AATATCATCCACCTGTTTACCCTGACCAATCTGGGAGCCCCTGCCGCCTT
CAAGTACTTTGACACCACCATCGACCGGAAGAGGTACACCAGCACCAAAG
AGGTGCTGGACGCCACCCTGATCCACCAGAGCATCACCGGCCTGTACGAG
ACACGGATCGACCTGTCTCAGCTGGGAGGCGACAAAAGGCCGGCGGCCAC
GAAAAAGGCCGGCCAGGCAAAAAAGAAAAAGtaa
```

36. Sp_del(175-307)-A(EAAAK)3A ("A(EAAAK)3A"
disclosed as SEQ ID NO: 3)

(SEQ ID NO: 105)
```
ATGGCCCCAAAGAAGAAGCGGAAGGTCGGTATCCACGGAGTCCCAGCAGC
CGACAAGAAGTACAGCATCGGCCTGGACATCGGCACCAACTCTGTGGGCT
GGGCCGTGATCACCGACGAGTACAAGGTGCCCAGCAAGAAATTCAAGGTG
CTGGGCAACACCGACCGGCACAGCATCAAGAAGAACCTGATCGGAGCCCT
GCTGTTCGACAGCGGCGAAACAGCCGAGGCCACCCGGCTGAAGAGAACCG
CCAGAAGAAGATACACCAGACGGAAGAACCGGATCTGCTATCTGCAAGAG
ATCTTCAGCAACGAGATGGCCAAGGTGGACGACAGCTTCTTCCACAGACT
GGAAGAGTCCTTCCTGGTGGAAGAGGATAAGAAGCACGAGCGGCACCCCA
TCTTCGGCAACATCGTGGACGAGGTGGCCTACCACGAGAAGTACCCCACC
ATCTACCACCTGAGAAAGAAACTGGTGGACAGCACCGACAAGGCCGACCT
GCGGCTGATCTATCTGGCCCTGGCCCACATGATCAAGTTCCGGGGCCACT
TCCTGATCGAGGGCGACCTGgctGAAGCTGCTGCTAAAGAAGCTGCTGCT
AAAGAAGCTGCTGCTAAAgctGTGAACACCGAGATCACCAAGGCCCCCCT
GAGCGCCTCTATGATCAAGAGATACGACGAGCACCACCAGGACCTGACCC
TGCTGAAAGCTCTCGTGCGGCAGCAGCTGCCTGAGAAGTACAAAGAGATT
TTCTTCGACCAGAGCAAGAACGGCTACGCCGGCTACATTGACGGCGGAGC
CAGCCAGGAAGAGTTCTACAAGTTCATCAAGCCCATCCTGGAAAAGATGG
ACGGCACCGAGGAACTGCTCGTGAAGCTGAACAGAGAGGACCTGCTGCGG
AAGCAGCGGACCTTCGACAACGGCAGCATCCCCCACCAGATCCACCTGGG
AGAGCTGCACGCCATTCTGCGGCGGCAGGAAGATTTTTACCCATTCCTGA
AGGACAACCGGGAAAAGATCGAGAAGATCCTGACCTTCCGCATCCCCTAC
TACGTGGGCCCTCTGGCCAGGGGAAACAGCAGATTCGCCTGGATGACCAG
AAAGAGCGAGGAAACCATCACCCCCTGGAACTTCGAGGAAGTGGTGGACA
AGGGCGCTTCCGCCCAGAGCTTCATCGAGCGGATGACCAACTTCGATAAG
AACCTGCCCAACGAGAAGGTGCTGCCCAAGCACAGCCTGCTGTACGAGTA
CTTCACCGTGTATAACGAGCTGACCAAAGTGAAATACGTGACCGAGGGAA
TGAGAAAGCCCGCCTTCCTGAGCGGCGAGCAGAAAAAGGCCATCGTGGAC
CTGCTGTTCAAGACCAACCGGAAAGTGACCGTGAAGCAGCTGAAAGAGGA
CTACTTCAAGAAAATCGAGTGCTTCGACTCCGTGGAAATCTCCGGCGTGG
AAGATCGGTTCAACGCCTCCCTGGGCACATACCACGATCTGCTGAAAATT
ATCAAGGACAAGGACTTCCTGGACAATGAGGAAAACGAGGACATTCTGGA
AGATATCGTGCTGACCCTGACACTGTTTGAGGACAGAGAGATGATCGAGG
AACGGCTGAAAACCTATGCCCACCTGTTCGACGACAAAGTGATGAAGCAG
CTGAAGCGGCGGAGATACACCGGCTGGGGCAGGCTGAGCCGGAAGCTGAT
CAACGGCATCCGGGACAAGCAGTCCGGCAAGACAATCCTGGATTTCCTGA
AGTCCGACGGCTTCGCCAACAGAAACTTCATGCAGCTGATCCACGACGAC
AGCCTGACCTTTAAAGAGGACATCCAGAAAGCCCAGGTGTCCGGCCAGGG
CGATAGCCTGCACGAGCACATTGCCAATCTGGCCGGCAGCCCCGCCATTA
AGAAGGGCATCCTGCAGACAGTGAAGGTGGTGGACGAGCTCGTGAAAGTG
ATGGGCCGGCACAAGCCCGAGAACATCGTGATCGAAATGGCCAGAGAGAA
CCAGACCACCCAGAAGGGACAGAAGAACAGCCGCGAGAGAATGAAGCGGA
TCGAAGAGGGCATCAAAGAGCTGGGCAGCCAGATCCTGAAAGAACACCCC
GTGGAAAACACCCAGCTGCAGAACGAGAAGCTGTACCTGTACTACCTGCA
GAATGGGCGGGATATGTACGTGGACCAGGAACTGGACATCAACCGGCTGT
CCGACTACGATGTGGACCATATCGTGCCTCAGAGCTTTCTGAAGGACGAC
TCCATCGACAACAAGGTGCTGACCAGAAGCGACAAGAACCGGGGCAAGAG
CGACAACGTGCCCTCCGAAGAGGTCGTGAAGAAGATGAAGAACTACTGGC
GGCAGCTGCTGAACGCCAAGCTGATTACCCAGAGAAAGTTCGACAATCTG
ACCAAGGCCGAGAGAGGCGGCCTGAGCGAACTGGATAAGGCCGGCTTCAT
CAAGAGACAGCTGGTGGAAACCCGGCAGATCACAAAGCACGTGGCACAGA
TCCTGGACTCCCGGATGAACACTAAGTACGACGAGAATGACAAGCTGATC
CGGGAAGTGAAAGTGATCACCCTGAAGTCCAAGCTGGTGTCCGATTTCCG
GAAGGATTTCCAGTTTTACAAAGTGCGCGAGATCAACAACTACCACCACG
CCCACGACGCCTACCTGAACGCCGTCGTGGGAACCGCCCTGATCAAAAAG
TACCCTAAGCTGGAAAGCGAGTTCGTGTACGGCGACTACAAGGTGTACGA
CGTGCGGAAGATGATCGCCAAGAGCGAGCAGGAAATCGGCAAGGCTACCG
CCAAGTACTTCTTCTACAGCAACATCATGAACTTTTTCAAGACCGAGATT
ACCCTGGCCAACGGCGAGATCCGGAAGCGGCCTCTGATCGAGACAAACGG
CGAAACCGGGGAGATCGTGTGGGATAAGGGCCGGGATTTTGCCACCGTGC
GGAAAGTGCTGAGCATGCCCCAAGTGAATATCGTGAAAAAGACCGAGGTG
CAGACAGGCGGCTTCAGCAAAGAGTCTATCCTGCCCAAGAGGAACAGCGA
TAAGCTGATCGCCAGAAAGAAGGACTGGGACCCTAAGAAGTACGGCGGCT
TCGACAGCCCCACCGTGGCCTATTCTGTGCTGGTGGTGGCCAAAGTGGAA
AAGGGCAAGTCCAAGAAACTGAAGAGTGTGAAAGAGCTGCTGGGGATCAC
CATCATGGAAAGAAGCAGCTTCGAGAAGAATCCCATCGACTTTCTGGAAG
CCAAGGGCTACAAAGAAGTGAAAAAGGACCTGATCATCAAGCTGCCTAAG
TACTCCCTGTTCGAGCTGGAAAACGGCCGGAAGAGAATGCTGGCCTCTGC
CGGCGAACTGCAGAAGGGAAACGAACTGGCCCTGCCCTCCAAATATGTGA
ACTTCCTGTACCTGGCCAGCCACTATGAGAAGCTGAAGGGCTCCCCCGAG
GATAATGAGCAGAAACAGCTGTTTGTGGAACAGCACAAGCACTACCTGGA
CGAGATCATCGAGCAGATCAGCGAGTTCTCCAAGAGAGTGATCCTGGCCG
ACGCTAATCTGGACAAAGTGCTGTCCGCCTACAACAAGCACCGGGATAAG
CCCATCAGAGAGCAGGCCGAGAATATCATCCACCTGTTTACCCTGACCAA
TCTGGGAGCCCCTGCCGCCTTCAAGTACTTTGACACCACCATCGACCGGA
```

-continued

AGAGGTACACCAGCACCAAAGAGGTGCTGGACGCCACCCTGATCCACCAG
AGCATCACCGGCCTGTACGAGACACGGATCGACCTGTCTCAGCTGGGAGG
CGACAAAAGGCCGGCGGCCACGAAAAAGGCCGGCCAGGCAAAAAAGAAAA
AGtaa 37. Sp_del(175-307)-A(EAAAK)3ALEA(EAAAK)3A
("A(EAAAK)3ALEA(EAAAK)3A" disclosed as
SEQ ID NO: 93)
(SEQ ID NO: 106)
ATGGCCCCAAAGAAGAAGCGGAAGGTCGGTATCCACGGAGTCCCAGCAGC
CGACAAGAAGTACAGCATCGGCCTGGACATCGGCACCAACTCTGTGGGCT
GGGCCGTGATCACCGACGAGTACAAGGTGCCCAGCAAGAAATTCAAGGTG
CTGGGCAACACCGACCGGCACAGCATCAAGAAGAACCTGATCGGAGCCCT
GCTGTTCGACAGCGGCGAAACAGCCGAGGCCACCCGGCTGAAGAGAACCG
CCAGAAGAAGATACACCAGACGGAAGAACCGGATCTGCTATCTGCAAGAG
ATCTTCAGCAACGAGATGGCCAAGGTGGACGACAGCTTCTTCCACAGACT
GGAAGAGTCCTTCCTGGTGGAAGAGGATAAGAAGCACGAGCGGCACCCCA
TCTTCGGCAACATCGTGGACGAGGTGGCCTACCACGAGAAGTACCCCACC
ATCTACCACCTGAGAAAGAAACTGGTGGACAGCACCGACAAGGCCGACCT
GCGGCTGATCTATCTGGCCCTGGCCCACATGATCAAGTTCCGGGGCCACT
TCCTGATCGAGGGCGACCTGgctGAAGCCGCTGCTAAAGAAGCcGCTGCT
AAAGAAGCcGCTGCTAAAGccCTGGAGgctGAAGCcGCTGCTAAAGAAGC
cGCTGCTAAAGAAGCCGCTGCTAAAgctGTGAACACCGAGATCACCAAGG
CCCCCCTGAGCGCCTCTATGATCAAGAGATACGACGAGCACCACCAGGAC
CTGACCCTGCTGAAAGCTCTCGTGCGGCAGCAGCTGCCTGAGAAGTACAA
AGAGATTTTCTTCGACCAGAGCAAGAACGGCTACGCCGGCTACATTGACG
GCGGAGCCAGCCAGGAAGAGTTCTACAAGTTCATCAAGCCCATCCTGGAA
AAGATGGACGGCACCGAGGAACTGCTCGTGAAGCTGAACAGAGAGGACCT
GCTGCGGAAGCAGCGGACCTTCGACAACGGCAGCATCCCCCACCAGATCC
ACCTGGGAGAGCTGCACGCCATTCTGCGGCGGCAGGAAGATTTTTACCCA
TTCCTGAAGGACAACCGGGAAAAGATCGAGAAGATCCTGACCTTCCGCAT
CCCCTACTACGTGGGCCCTCTGGCCAGGGGAAACAGCAGATTCGCCTGGA
TGACCAGAAAGAGCGAGGAAACCATCACCCCCTGGAACTTCGAGGAAGTG
GTGGACAAGGGCGCTTCCGCCCAGAGCTTCATCGAGCGGATGACCAACTT
CGATAAGAACCTGCCCAACGAGAAGGTGCTGCCCAAGCACAGCCTGCTGT
ACGAGTACTTCACCGTGTATAACGAGCTGACCAAAGTGAAATACGTGACC
GAGGGAATGAGAAAGCCCGCCTTCCTGAGCGGCGAGCAGAAAAAGGCCAT
CGTGGACCTGCTGTTCAAGACCAACCGGAAAGTGACCGTGAAGCAGCTGA
AAGAGGACTACTTCAAGAAAATCGAGTGCTTCGACTCCGTGGAAATCTCC
GGCGTGGAAGATCGGTTCAACGCCTCCCTGGGCACATACCACGATCTGCT
GAAAATTATCAAGGACAAGGACTTCCTGGACAATGAGGAAAACGAGGACA
TTCTGGAAGATATCGTGCTGACCCTGACACTGTTTGAGGACAGAGAGATG
ATCGAGGAACGGCTGAAAACCTATGCCCACCTGTTCGACGACAAAGTGAT
GAAGCAGCTGAAGCGGCGGAGATACACCGGCTGGGGCAGGCTGAGCCGGA -continued AGCTGATCAACGGCATCCGGGACAAGCAGTCCGGCAAGACAATCCTGGAT
TTCCTGAAGTCCGACGGCTTCGCCAACAGAAACTTCATGCAGCTGATCCA
CGACGACAGCCTGACCTTTAAAGAGGACATCCAGAAAGCCCAGGTGTCCG
GCCAGGGCGATAGCCTGCACGAGCACATTGCCAATCTGGCCGGCAGCCCC
GCCATTAAGAAGGGCATCCTGCAGACAGTGAAGGTGGTGGACGAGCTCGT
GAAAGTGATGGGCCGGCACAAGCCCGAGAACATCGTGATCGAAATGGCCA
GAGAGAACCAGACCACCCAGAAGGGACAGAAGAACAGCCGCGAGAGAATG
AAGCGGATCGAAGAGGGCATCAAAGAGCTGGGCAGCCAGATCCTGAAAGA
ACACCCCGTGGAAAACACCCAGCTGCAGAACGAGAAGCTGTACCTGTACT
ACCTGCAGAATGGGCGGGATATGTACGTGGACCAGGAACTGGACATCAAC
CGGCTGTCCGACTACGATGTGGACCATATCGTGCCTCAGAGCTTTCTGAA
GGACGACTCCATCGACAACAAGGTGCTGACCAGAAGCGACAAGAACCGGG
GCAAGAGCGACAACGTGCCCTCCGAAGAGGTCGTGAAGAAGATGAAGAAC
TACTGGCGGCAGCTGCTGAACGCCAAGCTGATTACCCAGAGAAAGTTCGA
CAATCTGACCAAGGCCGAGAGAGGCGGCCTGAGCGAACTGGATAAGGCCG
GCTTCATCAAGAGACAGCTGGTGGAAACCCGGCAGATCACAAAGCACGTG
GCACAGATCCTGGACTCCCGGATGAACACTAAGTACGACGAGAATGACAA
GCTGATCCGGGAAGTGAAAGTGATCACCCTGAAGTCCAAGCTGGTGTCCG
ATTTCCGGAAGGATTTCCAGTTTTACAAAGTGCGCGAGATCAACAACTAC
CACCACGCCCACGACGCCTACCTGAACGCCGTCGTGGGAACCGCCCTGAT
CAAAAAGTACCCTAAGCTGGAAAGCGAGTTCGTGTACGGCGACTACAAGG
TGTACGACGTGCGGAAGATGATCGCCAAGAGCGAGCAGGAAATCGGCAAG
GCTACCGCCAAGTACTTCTTCTACAGCAACATCATGAACTTTTTCAAGAC
CGAGATTACCCTGGCCAACGGCGAGATCCGGAAGCGGCCTCTGATCGAGA
CAAACGGCGAAACCGGGGAGATCGTGTGGGATAAGGGCCGGGATTTTGCC
ACCGTGCGGAAAGTGCTGAGCATGCCCCAAGTGAATATCGTGAAAAAGAC
CGAGGTGCAGACAGGCGGCTTCAGCAAAGAGTCTATCCTGCCCAAGAGGA
ACAGCGATAAGCTGATCGCCAGAAAGAAGGACTGGGACCCTAAGAAGTAC
GGCGGCTTCGACAGCCCCACCGTGGCCTATTCTGTGCTGGTGGTGGCCAA
AGTGGAAAAGGGCAAGTCCAAGAAACTGAAGAGTGTGAAAGAGCTGCTGG
GGATCACCATCATGGAAAGAAGCAGCTTCGAGAAGAATCCCATCGACTTT
CTGGAAGCCAAGGGCTACAAAGAAGTGAAAAAGGACCTGATCATCAAGCT
GCCTAAGTACTCCCTGTTCGAGCTGGAAAACGGCCGGAAGAGAATGCTGG
CCTCTGCCGGCGAACTGCAGAAGGGAAACGAACTGGCCCTGCCCTCCAAA
TATGTGAACTTCCTGTACCTGGCCAGCCACTATGAGAAGCTGAAGGGCTC
CCCCGAGGATAATGAGCAGAAACAGCTGTTTGTGGAACAGCACAAGCACT
ACCTGGACGAGATCATCGAGCAGATCAGCGAGTTCTCCAAGAGAGTGATC
CTGGCCGACGCTAATCTGGACAAAGTGCTGTCCGCCTACAACAAGCACCG
GGATAAGCCCATCAGAGAGCAGGCCGAGAATATCATCCACCTGTTTACCC
TGACCAATCTGGGAGCCCCTGCCGCCTTCAAGTACTTTGACACCACCATC -continued

GACCGGAAGAGGTACACCAGCACCAAAGAGGTGCTGGACGCCACCCTGAT

CCACCAGAGCATCACCGGCCTGTACGAGACACGGATCGACCTGTCTCAGC

TGGGAGGCGACAAAAGGCCGGCGGCCACGAAAAAGGCCGGCCAGGCAAAA

AAGAAAAAGtaa

38. Sp_del(175-307)-
A(EAAAK)3ALEA(EAAAK)3ALEA(EAAAK)3A
("A(EAAAK)3ALEA(EAAAK)3ALEA(EAAAK)3A" disclosed
as SEQ ID NO: 95)

(SEQ ID NO: 107)

ATGGCCCCAAAGAAGAAGCGGAAGGTCGGTATCCACGGAGTCCCAGCAGC

CGACAAGAAGTACAGCATCGGCCTGGACATCGGCACCAACTCTGTGGGCT

GGGCCGTGATCACCGACGAGTACAAGGTGCCCAGCAAGAAATTCAAGGTG

CTGGGCAACACCGACCGGCACAGCATCAAGAAGAACCTGATCGGAGCCCT

GCTGTTCGACAGCGGCGAAACAGCCGAGGCCACCCGGCTGAAGAGAACCG

CCAGAAGAAGATACACCAGACGGAAGAACCGGATCTGCTATCTGCAAGAG

ATCTTCAGCAACGAGATGGCCAAGGTGGACGACAGCTTCTTCCACAGACT

GGAAGAGTCCTTCCTGGTGGAAGAGGATAAGAAGCACGAGCGGCACCCCA

TCTTCGGCAACATCGTGGACGAGGTGGCCTACCACGAGAAGTACCCCACC

ATCTACCACCTGAGAAAGAAACTGGTGGACAGCACCGACAAGGCCGACCT

GCGGCTGATCTATCTGGCCCTGGCCCACATGATCAAGTTCCGGGGCCACT

TCCTGATCGAGGGCGACCTGgctGAAGCTGCTGCTAAAGAAGCTGCTGCT

AAAGAAGCTGCTGCTAAAGccCTGGAGgctGAAGCTGCTGCTAAAGAAGC

TGCTGCTAAAGAAGCTGCTGCTAAAGccCTGGAGgctGAAGCTGCTGCTA

AAGAAGCTGCTGCTAAAGAAGCTGCTGCTAAAgctGTGAACACCGAGATC

ACCAAGGCCCCCCTGAGCGCCTCTATGATCAAGAGATACGACGAGCACCA

CCAGGACCTGACCCTGCTGAAAGCTCTCGTGCGGCAGCAGCTGCCTGAGA

AGTACAAAGAGATTTTCTTCGACCAGAGCAAGAACGGCTACGCCGGCTAC

ATTGACGGCGGAGCCAGCCAGGAAGAGTTCTACAAGTTCATCAAGCCCAT

CCTGGAAAAGATGGACGGCACCGAGGAACTGCTCGTGAAGCTGAACAGAG

AGGACCTGCTGCGGAAGCAGCGGACCTTCGACAACGGCAGCATCCCCCAC

CAGATCCACCTGGGAGAGCTGCACGCCATTCTGCGGCGGCAGGAAGATTT

TTACCCATTCCTGAAGGACAACCGGGAAAAGATCGAGAAGATCCTGACCT

TCCGCATCCCCTACTACGTGGGCCCTCTGGCCAGGGGAAACAGCAGATTC

GCCTGGATGACCAGAAAGAGCGAGGAAACCATCACCCCCTGGAACTTCGA

GGAAGTGGTGGACAAGGGCGCTTCCGCCCAGAGCTTCATCGAGCGGATGA

CCAACTTCGATAAGAACCTGCCCAACGAGAAGGTGCTGCCCAAGCACAGC

CTGCTGTACGAGTACTTCACCGTGTATAACGAGCTGACCAAAGTGAAATA

CGTGACCGAGGGAATGAGAAAGCCCGCCTTCCTGAGCGGCGAGCAGAAAA

AGGCCATCGTGGACCTGCTGTTCAAGACCAACCGGAAAGTGACCGTGAAG

CAGCTGAAAGAGGACTACTTCAAGAAAATCGAGTGCTTCGACTCCGTGGA

AATCTCCGGCGTGGAAGATCGGTTCAACGCCTCCCTGGGCACATACCACG

ATCTGCTGAAAATTATCAAGGACAAGGACTTCCTGGACAATGAGGAAAAC

GAGGACATTCTGGAAGATATCGTGCTGACCCTGACACTGTTTGAGGACAG

-continued

AGAGATGATCGAGGAACGGCTGAAAACCTATGCCCACCTGTTCGACGACA

AAGTGATGAAGCAGCTGAAGCGGCGGAGATACACCGGCTGGGGCAGGCTG

AGCCGGAAGCTGATCAACGGCATCCGGGACAAGCAGTCCGGCAAGACAAT

CCTGGATTTCCTGAAGTCCGACGGCTTCGCCAACAGAAACTTCATGCAGC

TGATCCACGACGACAGCCTGACCTTTAAAGAGGACATCCAGAAAGCCCAG

GTGTCCGGCCAGGGCGATAGCCTGCACGAGCACATTGCCAATCTGGCCGG

CAGCCCCGCCATTAAGAAGGGCATCCTGCAGACAGTGAAGGTGGTGGACG

AGCTCGTGAAAGTGATGGGCCGGCACAAGCCCGAGAACATCGTGATCGAA

ATGGCCAGAGAGAACCAGACCACCCAGAAGGGACAGAAGAACAGCCGCGA

GAGAATGAAGCGGATCGAAGAGGGCATCAAAGAGCTGGGCAGCCAGATCC

TGAAAGAACACCCCGTGGAAAACACCCAGCTGCAGAACGAGAAGCTGTAC

CTGTACTACCTGCAGAATGGGCGGGATATGTACGTGGACCAGGAACTGGA

CATCAACCGGCTGTCCGACTACGATGTGGACCATATCGTGCCTCAGAGCT

TTCTGAAGGACGACTCCATCGACAACAAGGTGCTGACCAGAAGCGACAAG

AACCGGGGCAAGAGCGACAACGTGCCCTCCGAAGAGGTCGTGAAGAAGAT

GAAGAACTACTGGCGGCAGCTGCTGAACGCCAAGCTGATTACCCAGAGAA

AGTTCGACAATCTGACCAAGGCCGAGAGAGGCGGCCTGAGCGAACTGGAT

AAGGCCGGCTTCATCAAGAGACAGCTGGTGGAAACCCGGCAGATCACAAA

GCACGTGGCACAGATCCTGGACTCCCGGATGAACACTAAGTACGACGAGA

ATGACAAGCTGATCCGGGAAGTGAAAGTGATCACCCTGAAGTCCAAGCTG

GTGTCCGATTTCCGGAAGGATTTCCAGTTTTACAAAGTGCGCGAGATCAA

CAACTACCACCACGCCCACGACGCCTACCTGAACGCCGTCGTGGGAACCG

CCCTGATCAAAAAGTACCCTAAGCTGGAAAGCGAGTTCGTGTACGGCGAC

TACAAGGTGTACGACGTGCGGAAGATGATCGCCAAGAGCGAGCAGGAAAT

CGGCAAGGCTACCGCCAAGTACTTCTTCTACAGCAACATCATGAACTTTT

TCAAGACCGAGATTACCCTGGCCAACGGCGAGATCCGGAAGCGGCCTCTG

ATCGAGACAAACGGCGAAACCGGGGAGATCGTGTGGGATAAGGGCCGGGA

TTTTGCCACCGTGCGGAAAGTGCTGAGCATGCCCCAAGTGAATATCGTGA

AAAAGACCGAGGTGCAGACAGGCGGCTTCAGCAAAGAGTCTATCCTGCCC

AAGAGGAACAGCGATAAGCTGATCGCCAGAAAGAAGGACTGGGACCCTAA

GAAGTACGGCGGCTTCGACAGCCCCACCGTGGCCTATTCTGTGCTGGTGG

TGGCCAAAGTGGAAAAGGGCAAGTCCAAGAAACTGAAGAGTGTGAAAGAG

CTGCTGGGGATCACCATCATGGAAAGAAGCAGCTTCGAAGAGAATCCCAT

CGACTTTCTGGAAGCCAAGGGCTACAAAGAAGTGAAAAAGGACCTGATCA

TCAAGCTGCCTAAGTACTCCCTGTTCGAGCTGGAAAACGGCCGGAAGAGA

ATGCTGGCCTCTGCCGGCGAACTGCAGAAGGGAAACGAACTGGCCCTGCC

CTCCAAATATGTGAACTTCCTGTACCTGGCCAGCCACTATGAGAAGCTGA

AGGGCTCCCCCGAGGATAATGAGCAGAAACAGCTGTTTGTGGAACAGCAC

AAGCACTACCTGGACGAGATCATCGAGCAGATCAGCGAGTTCTCCAAGAG

AGTGATCCTGGCCGACGCTAATCTGGACAAAGTGCTGTCCGCCTACAACA

AGCACCGGGATAAGCCCATCAGAGAGCAGGCCGAGAATATCATCCACCTG

-continued

TTTACCCTGACCAATCTGGGAGCCCCTGCCGCCTTCAAGTACTTTGACAC

CACCATCGACCGGAAGAGGTACACCAGCACCAAAGAGGTGCTGGACGCCA

CCCTGATCCACCAGAGCATCACCGGCCTGTACGAGACACGGATCGACCTG

TCTCAGCTGGGAGGCGACAAAAGGCCGGCGGCCACGAAAAAGGCCGGCCA

GGCAAAAAAGAAAAAGtaa

39. Sp_del(175-307)-
A(EAAAK)3ALEA(EAAAK)3ALEA(EAAAK)3ALEA(EAAAK)3A
("A(EAAAK)3ALEA(EAAAK)3ALEA(EAAAK)3ALEA(EAAAK)3A"
disclosed as SEQ ID NO: 97)
(SEQ ID NO: 108)
ATGGCCCCAAAGAAGAAGCGGAAGGTCGGTATCCACGGAGTCCCAGCAGC

CGACAAGAAGTACAGCATCGGCCTGGACATCGGCACCAACTCTGTGGGCT

GGGCCGTGATCACCGACGAGTACAAGGTGCCCAGCAAGAAATTCAAGGTG

CTGGGCAACACCGACCGGCACAGCATCAAGAAGAACCTGATCGGAGCCCT

GCTGTTCGACAGCGGCGAAACAGCCGAGGCCACCCGGCTGAAGAGAACCG

CCAGAAGAAGATACACCAGACGGAAGAACCGGATCTGCTATCTGCAAGAG

ATCTTCAGCAACGAGATGGCCAAGGTGGACGACAGCTTCTTCCACAGACT

GGAAGAGTCCTTCCTGGTGGAAGAGGATAAGAAGCACGAGCGGCACCCCA

TCTTCGGCAACATCGTGGACGAGGTGGCCTACCACGAGAAGTACCCCACC

ATCTACCACCTGAGAAAGAAACTGGTGGACAGCACCGACAAGGCCGACCT

GCGGCTGATCTATCTGGCCCTGGCCCACATGATCAAGTTCCGGGGCCACT

TCCTGATCGAGGGCGACCTGgctGAAGCTGCTGCTAAAGAAGCTGCTGCT

AAAGAAGCTGCTGCTAAAGccCTGGAGgctGAAGCTGCTGCTAAAGAAGC

TGCTGCTAAAGAAGCTGCTGCTAAAGccCTGGAGgctGAAGCTGCTGCTA

AAGAAGCTGCTGCTAAAGAAGCTGCTGCTAAAGccCTGGAGgctGAAGCT

GCTGCTAAAGAAGCTGCTGCTAAAGAAGCTGCTGCTAAAGctGTGAACAC

CGAGATCACCAAGGCCCCCCTGAGCGCCTCTATGATCAAGAGATACGACG

AGCACCACCAGGACCTGACCCTGCTGAAAGCTCTCGTGCGGCAGCAGCTG

CCTGAGAAGTACAAAGAGATTTTCTTCGACCAGAGCAAGAACGGCTACGC

CGGCTACATTGACGGCGGAGCCAGCCAGGAAGAGTTCTACAAGTTCATCA

AGCCCATCCTGGAAAAGATGGACGGCACCGAGGAACTGCTCGTGAAGCTG

AACAGAGAGGACCTGCTGCGGAAGCAGCGGACCTTCGACAACGGCAGCAT

CCCCCACCAGATCCACCTGGGAGAGCTGCACGCCATTCTGCGGCGGCAGG

AAGATTTTTACCCATTCCTGAAGGACAACCGGGAAAAGATCGAGAAGATC

CTGACCTTCCGCATCCCCTACTACGTGGGCCCTCTGGCCAGGGGAAACAG

CAGATTCGCCTGGATGACCAGAAAGAGCGAGGAAACCATCACCCCCTGGA

ACTTCGAGGAAGTGGTGGACAAGGGCGCTTCCGCCCAGAGCTTCATCGAG

CGGATGACCAACTTCGATAAGAACCTGCCCAACGAGAAGGTGCTGCCCAA

GCACAGCCTGCTGTACGAGTACTTCACCGTGTATAACGAGCTGACCAAAG

TGAAATACGTGACCGAGGGAATGAGAAAGCCCGCCTTCCTGAGCGGCGAG

CAGAAAAAGGCCATCGTGGACCTGCTGTTCAAGACCAACCGGAAAGTGAC

CGTGAAGCAGCTGAAAGAGGACTACTTCAAGAAAATCGAGTGCTTCGACT

CCGTGGAAATCTCCGGCGTGGAAGATCGGTTCAACGCCTCCCTGGGCACA

TACCACGATCTGCTGAAAATTATCAAGGACAAGGACTTCCTGGACAATGA

GGAAAACGAGGACATTCTGGAAGATATCGTGCTGACCCTGACACTGTTTG

AGGACAGAGAGATGATCGAGGAACGGCTGAAAACCTATGCCCACCTGTTC

GACGACAAAGTGATGAAGCAGCTGAAGCGGCGGAGATACACCGGCTGGGG

CAGGCTGAGCCGGAAGCTGATCAACGGCATCCGGGACAAGCAGTCCGGCA

AGACAATCCTGGATTTCCTGAAGTCCGACGGCTTCGCCAACAGAAACTTC

ATGCAGCTGATCCACGACGACAGCCTGACCTTTAAAGAGGACATCCAGAA

AGCCCAGGTGTCCGGCCAGGGCGATAGCCTGCACGAGCACATTGCCAATC

TGGCCGGCAGCCCCGCCATTAAGAAGGGCATCCTGCAGACAGTGAAGGTG

GTGGACGAGCTCGTGAAAGTGATGGGCCGGCACAAGCCCGAGAACATCGT

GATCGAAATGGCCAGAGAGAACCAGACCACCCAGAAGGGACAGAAGAACA

GCCGCGAGAGAATGAAGCGGATCGAAGAGGGCATCAAAGAGCTGGGCAGC

CAGATCCTGAAAGAACACCCCGTGGAAAACACCCAGCTGCAGAACGAGAA

GCTGTACCTGTACTACCTGCAGAATGGGCGGGATATGTACGTGGACCAGG

AACTGGACATCAACCGGCTGTCCGACTACGATGTGGACCATATCGTGCCT

CAGAGCTTTCTGAAGGACGACTCCATCGACAACAAGGTGCTGACCAGAAG

CGACAAGAACCGGGGCAAGAGCGACAACGTGCCCTCCGAAGAGGTCGTGA

AGAAGATGAAGAACTACTGGCGGCAGCTGCTGAACGCCAAGCTGATTACC

CAGAGAAAGTTCGACAATCTGACCAAGGCCGAGAGAGGCGGCCTGAGCGA

ACTGGATAAGGCCGGCTTCATCAAGAGACAGCTGGTGGAAACCCGGCAGA

TCACAAAGCACGTGGCACAGATCCTGGACTCCCGGATGAACACTAAGTAC

GACGAGAATGACAAGCTGATCCGGGAAGTGAAAGTGATCACCCTGAAGTC

CAAGCTGGTGTCCGATTTCCGGAAGGATTTCCAGTTTTACAAAGTGCGCG

AGATCAACAACTACCACCACGCCCACGACGCCTACCTGAACGCCGTCGTG

GGAACCGCCCTGATCAAAAAGTACCCTAAGCTGGAAAGCGAGTTCGTGTA

CGGCGACTACAAGGTGTACGACGTGCGGAAGATGATCGCCAAGAGCGAGC

AGGAAATCGGCAAGGCTACCGCCAAGTACTTCTTCTACAGCAACATCATG

AACTTTTTCAAGACCGAGATTACCCTGGCCAACGGCGAGATCCGGAAGCG

GCCTCTGATCGAGACAAACGGCGAAACCGGGGAGATCGTGTGGGATAAGG

GCCGGGATTTTGCCACCGTGCGGAAAGTGCTGAGCATGCCCCAAGTGAAT

ATCGTGAAAAAGACCGAGGTGCAGACAGGCGGCTTCAGCAAAGAGTCTAT

CCTGCCCAAGAGGAACAGCGATAAGCTGATCGCCAGAAAGAAGGACTGGG

ACCCTAAGAAGTACGGCGGCTTCGACAGCCCCACCGTGGCCTATTCTGTG

CTGGTGGTGGCCAAAGTGGAAAAGGGCAAGTCCAAGAAACTGAAGAGTGT

GAAAGAGCTGCTGGGGATCACCATCATGGAAAGAAGCAGCTTCGAGAAGA

ATCCCATCGACTTTCTGGAAGCCAAGGGCTACAAAGAAGTGAAAAAGGAC

CTGATCATCAAGCTGCCTAAGTACTCCCTGTTCGAGCTGGAAAACGGCCG

GAAGAGAATGCTGGCCTCTGCCGGCGAACTGCAGAAGGGAAACGAACTGG

CCCTGCCCTCCAAATATGTGAACTTCCTGTACCTGGCCAGCCACTATGAG

AAGCTGAAGGGCTCCCCCGAGGATAATGAGCAGAAACAGCTGTTTGTGGA

-continued
```
ACAGCACAAGCACTACCTGGACGAGATCATCGAGCAGATCAGCGAGTTCT

CCAAGAGAGTGATCCTGGCCGACGCTAATCTGGACAAAGTGCTGTCCGCC

TACAACAAGCACCGGGATAAGCCCATCAGAGAGCAGGCCGAGAATATCAT

CCACCTGTTTACCCTGACCAATCTGGGAGCCCCTGCCGCCTTCAAGTACT

TTGACACCACCATCGACCGGAAGAGGTACACCAGCACCAAAGAGGTGCTG

GACGCCACCCTGATCCACCAGAGCATCACCGGCCTGTACGAGACACGGAT

CGACCTGTCTCAGCTGGGAGGCGACAAAAGGCCGGCGGCCACGAAAAAGG

CCGGCCAGGCAAAAAGAAAAAGtaa
```

Example 10: New Nickases

Figure 24A:
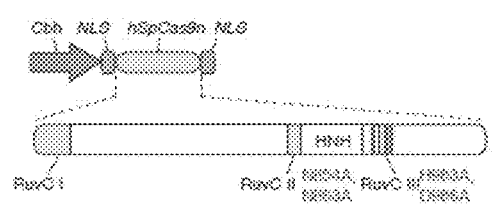
FIGS. 24A-C show, from the crystal structure, a schematic of showing catalytic domains of SpCas9, sites of mutagenesis for new nickases (A), a schematic showing locations of sgRNAs for testing double nicking (B), and results of a Surveyor gel test results showing 1 HNH mutant N854A that retains nickase activity, and 1 HNH mutant that shows nickase activity (N863A), and 2 RuvCIII mutants that show nickase activity (H983A, D986A) (C).
Figure 24B:
Figure 24C:
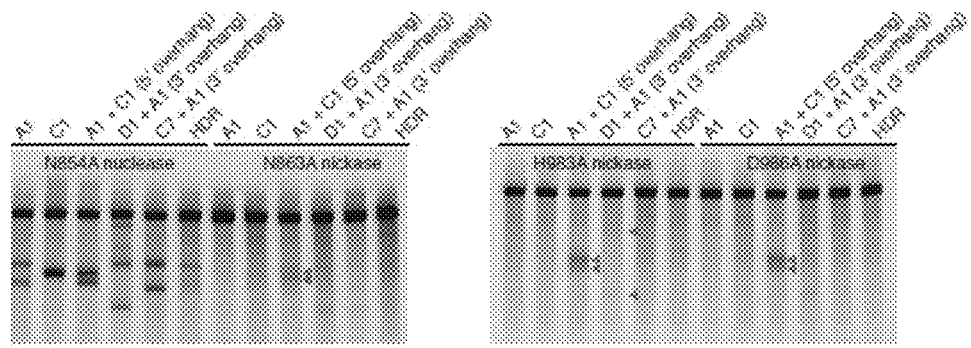

FIGS. 24A-C pertain to new SpCas9 nickases and provide A. Schematic showing catalytic domains of SpCas9, and sites of mutagenesis for putative new nickases. RuvC domains I, II, and III are shown in orange, HNH domain in white between RuvCII and RuvCIII. Domain sizes not drawn to scale. B. Schematic showing locations of sgRNAs used for testing double nicking: when sgRNAs are transfected singly (A1 or C1 alone) with SpCas9 nickases, no indels should result. The combination of A1+C1, used in combination with RuvCIII mutation nickases result in 5'-overhang, where as D1+A1 and C7+A1 would result in 3'-overhangs. Conversely, those three combinations used with HNH mutation nickases would result in 3'-, 5'-, and 5'-overhangs, respectively. C. Surveyor test showing 1 HNH mutant that retains nuclease activity (N854A), and 1 HNH mutant that shows nickase activity (N863A), as well as 2 RuvCIII mutants that show nickase activity (H983A, D986A).

In this Example, five potential nicking mutation sites were chosen based on sequence homology between Cas9 orthologs. And three additional sites were chosen based on herein crystallography data. A subset of these sets of nickase mutant Cas9s were re-cloned to incorporate both N' and C'-NLS sequences that are identical to those of optimized SpCas9. Sequences are below.

Nickase mutants were re-cloned to incorporated designated mutations into pAAV-vector under Cbh promoter and sequence validated.

Nuclease and double-nicking activities for all potential nickases were tested in HEK 293FT cells as follows: co-transfection of 400 ng of nickase and 100 ng of U6-driven sgRNA (100 ng for one guide, or 50 each for a pair of sgRNAs) by Lipofectamine 2000 into 200,000 cells. DNAs from transfected cells were collected for SURVEYOR analysis. Nickases do not result in indel mutations when co-transfected with a single sgRNA, but do when co-transfected with a pair of appropriately off-set sgRNAs. Based on data from the original D10A SpCas9 nickase, the pair of sgRNA chosen (A1/C1) for RuvC domain mutants have 0-bp offset and 5'-overhang for maximal cleavage.

| | Mutant domain | Functional? |
|---|---|---|
| Homology set: | | |
| Cbh-hSpCas9(D10A)-NLS | RuvCI | nickase activity |
| Cbh-hSpCas9(E762A)-NLS | RuvCII | |
| Cbh-hSpCas9(H840A)-NLS | HNH | no activity |
| Cbh-hSpCas9(N854A)-NLS | HNH | wt nuclease activity |
| Cbh-hSpCas9(N863A)-NLS | HNH | nickase activity |
| Cbh-hSpCas9(D986A)-NLS | RuvCIII | |

| | Mutant domain | Functional? |
|---|---|---|
| Crystal set set: | | |
| NLS-S15A-NLS | RuvCI | wt nuclease activity |
| NLS-E762A-NLS | RuvCII | catalytically dead |
| NLS-H982A-NLS | RuvCIII | wt nuclease activity |
| NLS-H983A-NLS | RuvCIII | nickase activity |
| NLS-D986A-NLS | RuvCIII | nickase activity |

>NLS-S15A-NLS (SEQ ID NO: 109)
```
ATGGCCCCAAAGAAGAAGCGGAAGGTCGGTATCCACGGAGTCCCAGCAGC

CGACAAGAAGTACAGCATCGGCCTGGACATCGGCACCAACgccGTGGGCT

GGGCCGTGATCACCGACGAGTACAAGGTGCCCAGCAAGAAATTCAAGGTG

CTGGGCAACACCGACCGGCACAGCATCAAGAAGAACCTGATCGGAGCCCT

GCTGTTCGACAGCGGCGAAACAGCCGAGGCCACCCGGCTGAAGAGAACCG

CCAGAAGAAGATACACCAGACGGAAGAACCGGATCTGCTATCTGCAAGAG

ATCTTCAGCAACGAGATGGCCAAGGTGGACGACAGCTTCTTCCACAGACT

GGAAGAGTCCTTCCTGGTGGAAGAGGATAAGAAGCACGAGCGGCACCCCA

TCTTCGGCAACATCGTGGACGAGGTGGCCTACCACGAGAAGTACCCCACC

ATCTACCACCTGAGAAAGAAACTGGTGGACAGCACCGACAAGGCCGACCT

GCGGCTGATCTATCTGGCCCTGGCCCACATGATCAAGTTCCGGGGCCACT

TCCTGATCGAGGGCGACCTGAACCCCGACAACAGCGACGTGGACAAGCTG

TTCATCCAGCTGGTGCAGACCTACAACCAGCTGTTCGAGGAAAACCCCAT

CAACGCCAGCGGCGTGGACGCCAAGGCCATCCTGTCTGCCAGACTGAGCA

AGAGCAGACGGCTGGAAAATCTGATCGCCCAGCTGCCCGGCGAGAAGAAG

AATGGCCTGTTCGGAAACCTGATTGCCCTGAGCCTGGGCCTGACCCCCAA

CTTCAAGAGCAACTTCGACCTGGCCGAGGATGCCAAACTGCAGCTGAGCA

AGGACACCTACGACGACGACCTGGACAACCTGCTGGCCCAGATCGGCGAC

CAGTACGCCGACCTGTTTCTGGCCGCCAAGAACCTGTCCGACGCCATCCT

GCTGAGCGACATCCTGAGAGTGAACACCGAGATCACCAAGGCCCCCCTGA

GCGCCTCTATGATCAAGAGATACGACGAGCACCACCAGGACCTGACCCTG

CTGAAAGCTCTCGTGCGGCAGCAGCTGCCTGAGAAGTACAAAGAGATTTT

CTTCGACCAGAGCAAGAACGGCTACGCCGGCTACATTGACGGCGGAGCCA

GCCAGGAAGAGTTCTACAAGTTCATCAAGCCCATCCTGGAAAAGATGGAC

GGCACCGAGGAACTGCTCGTGAAGCTGAACAGAGAGGACCTGCTGCGGAA

GCAGCGGACCTTCGACAACGGCAGCATCCCCCACCAGATCCACCTGGGAG

AGCTGCACGCCATTCTGCGGCGGCAGGAAGATTTTTACCCATTCCTGAAG

GACAACCGGGAAAAGATCGAGAAGATCCTGACCTTCCGCATCCCCTACTA

CGTGGGCCCTCTGGCCAGGGGAAACAGCAGATTCGCCTGGATGACCAGAA

AGAGCGAGGAAACCATCACCCCCTGGAACTTCGAGGAAGTGGTGGACAAG

GGCGCTTCCGCCCAGAGCTTCATCGAGCGGATGACCAACTTCGATAAGAA

CCTGCCCAACGAGAAGGTGCTGCCCAAGCACAGCCTGCTGTACGAGTACT
```

TCACCGTGTATAACGAGCTGACCAAAGTGAAATACGTGACCGAGGGAATG
AGAAAGCCCGCCTTCCTGAGCGGCGAGCAGAAAAAGGCCATCGTGGACCT
GCTGTTCAAGACCAACCGGAAAGTGACCGTGAAGCAGCTGAAAGAGGACT
ACTTCAAGAAAATCGAGTGCTTCGACTCCGTGGAAATCTCCGGCGTGGAA
GATCGGTTCAACGCCTCCCTGGGCACATACCACGATCTGCTGAAAATTAT
CAAGGACAAGGACTTCCTGGACAATGAGGAAAACGAGGACATTCTGGAAG
ATATCGTGCTGACCCTGACACTGTTTGAGGACAGAGAGATGATCGAGGAA
CGGCTGAAAACCTATGCCCACCTGTTCGACGACAAAGTGATGAAGCAGCT
GAAGCGGCGGAGATACACCGGCTGGGGCAGGCTGAGCCGGAAGCTGATCA
ACGGCATCCGGGACAAGCAGTCCGGCAAGACAATCCTGGATTTCCTGAAG
TCCGACGGCTTCGCCAACAGAAACTTCATGCAGCTGATCCACGACGACAG
CCTGACCTTTAAAGAGGACATCCAGAAAGCCCAGGTGTCCGGCCAGGGCG
ATAGCCTGCACGAGCACATTGCCAATCTGGCCGGCAGCCCCGCCATTAAG
AAGGGCATCCTGCAGACAGTGAAGGTGGTGGACGAGCTCGTGAAAGTGAT
GGGCCGGCACAAGCCCGAGAACATCGTGATCGAAATGGCCAGAGAGAACC
AGACCACCCAGAAGGGACAGAAGAACAGCCGCGAGAGAATGAAGCGGATC
GAAGAGGGCATCAAAGAGCTGGGCAGCCAGATCCTGAAAGAACACCCCGT
GGAAAACACCCAGCTGCAGAACGAGAAGCTGTACCTGTACTACCTGCAGA
ATGGGCGGGATATGTACGTGGACCAGGAACTGGACATCAACCGGCTGTCC
GACTACGATGTGGACCATATCGTGCCTCAGAGCTTTCTGAAGGACGACTC
CATCGACAACAAGGTGCTGACCAGAAGCGACAAGAACCGGGGCAAGAGCG
ACAACGTGCCCTCCGAAGAGGTCGTGAAGAAGATGAAGAACTACTGGCGG
CAGCTGCTGAACGCCAAGCTGATTACCCAGAGAAAGTTCGACAATCTGAC
CAAGGCCGAGAGAGGCGGCCTGAGCGAACTGGATAAGGCCGGCTTCATCA
AGAGACAGCTGGTGGAAACCCGGCAGATCACAAAGCACGTGGCACAGATC
CTGGACTCCCGGATGAACACTAAGTACGACGAGAATGACAAGCTGATCCG
GGAAGTGAAAGTGATCACCCTGAAGTCCAAGCTGGTGTCCGATTTCCGGA
AGGATTTCCAGTTTTACAAAGTGCGCGAGATCAACAACTACCACCACGCC
CACGACGCCTACCTGAACGCCGTCGTGGGAACCGCCCTGATCAAAAAGTA
CCCTAAGCTGGAAAGCGAGTTCGTGTACGGCGACTACAAGGTGTACGACG
TGCGGAAGATGATCGCCAAGAGCGAGCAGGAAATCGGCAAGGCTACCGCC
AAGTACTTCTTCTACAGCAACATCATGAACTTTTTCAAGACCGAGATTAC
CCTGGCCAACGGCGAGATCCGGAAGCGGCCTCTGATCGAGACAAACGGCG
AAACCGGGGAGATCGTGTGGGATAAGGGCCGGGATTTTGCCACCGTGCGG
AAAGTGCTGAGCATGCCCCAAGTGAATATCGTGAAAAAGACCGAGGTGCA
GACAGGCGGCTTCAGCAAGGAGTCTATCCTGCCCAAGAGGAACAGCGATA
AGCTGATCGCCAGAAAGAAGGACTGGGACCCTAAGAAGTACGGCGGCTTC
GACAGCCCCACCGTGGCCTATTCTGTGCTGGTGGTGGCCAAAGTGGAAAA
GGGCAAGTCCAAGAAACTGAAGAGTGTGAAAGAGCTGCTGGGGATCACCA
TCATGGAAAGAAGCAGCTTCGAGAAGAATCCCATCGACTTTCTGGAAGCC

AAGGGCTACAAAGAAGTGAAAAAGGACCTGATCATCAAGCTGCCTAAGTA
CTCCCTGTTCGAGCTGGAAAACGGCCGGAAGAGAATGCTGGCCTCTGCCG
GCGAACTGCAGAAGGGAAACGAACTGGCCCTGCCCTCCAAATATGTGAAC
TTCCTGTACCTGGCCAGCCACTATGAGAAGCTGAAGGGCTCCCCCGAGGA
TAATGAGCAGAAACAGCTGTTTGTGGAACAGCACAAGCACTACCTGGACG
AGATCATCGAGCAGATCAGCGAGTTCTCCAAGAGAGTGATCCTGGCCGAC
GCTAATCTGGACAAAGTGCTGTCCGCCTACAACAAGCACCGGGATAAGCC
CATCAGAGAGCAGGCCGAGAATATCATCCACCTGTTTACCCTGACCAATC
TGGGAGCCCCTGCCGCCTTCAAGTACTTTGACACCACCATCGACCGGAAG
AGGTACACCAGCACCAAAGAGGTGCTGGACGCCACCCTGATCCACCAGAG
CATCACCGGCCTGTACGAGACACGGATCGACCTGTCTCAGCTGGGAGGCG
ACAAAAGGCCGGCGGCCACGAAAAAGGCCGGCCAGGCAAAAAAGAAAAAG
taa >NLS-E762A-NLS
(SEQ ID NO: 110)
ATGGCCCCAAAGAAGAAGCGGAAGGTCGGTATCCACGGAGTCCCAGCAGC
CGACAAGAAGTACAGCATCGGCCTGGACATCGGCACCAACTCTGTGGGCT
GGGCCGTGATCACCGACGAGTACAAGGTGCCCAGCAAGAAATTCAAGGTG
CTGGGCAACACCGACCGGCACAGCATCAAGAAGAACCTGATCGGAGCCCT
GCTGTTCGACAGCGGCGAAACAGCCGAGGCCACCCGGCTGAAGAGAACCG
CCAGAAGAAGATACACCAGACGGAAGAACCGGATCTGCTATCTGCAAGAG
ATCTTCAGCAACGAGATGGCCAAGGTGGACGACAGCTTCTTCCACAGACT
GGAAGAGTCCTTCCTGGTGGAAGAGGATAAGAAGCACGAGCGGCACCCCA
TCTTCGGCAACATCGTGGACGAGGTGGCCTACCACGAGAAGTACCCCACC
ATCTACCACCTGAGAAAGAAACTGGTGGACAGCACCGACAAGGCCGACCT
GCGGCTGATCTATCTGGCCCTGGCCCACATGATCAAGTTCCGGGGCCACT
TCCTGATCGAGGGCGACCTGAACCCCGACAACAGCGACGTGGACAAGCTG
TTCATCCAGCTGGTGCAGACCTACAACCAGCTGTTCGAGGAAAACCCCAT
CAACGCCAGCGGCGTGGACGCCAAGGCCATCCTGTCTGCCAGACTGAGCA
AGAGCAGACGGCTGGAAAATCTGATCGCCCAGCTGCCCGGCGAGAAGAAG
AATGGCCTGTTCGGAAACCTGATTGCCCTGAGCCTGGGCCTGACCCCCAA
CTTCAAGAGCAACTTCGACCTGGCCGAGGATGCCAAACTGCAGCTGAGCA
AGGACACCTACGACGACGACCTGGACAACCTGCTGGCCCAGATCGGCGAC
CAGTACGCCGACCTGTTTCTGGCCGCCAAGAACCTGTCCGACGCCATCCT
GCTGAGCGACATCCTGAGAGTGAACACCGAGATCACCAAGGCCCCCCTGA
GCGCCTCTATGATCAAGAGATACGACGAGCACCACCAGGACCTGACCCTG
CTGAAAGCTCTCGTGCGGCAGCAGCTGCCTGAGAAGTACAAAGAGATTTT
CTTCGACCAGAGCAAGAACGGCTACGCCGGCTACATTGACGGCGGAGCCA
GCCAGGAAGAGTTCTACAAGTTCATCAAGCCCATCCTGGAAAAGATGGAC
GGCACCGAGGAACTGCTCGTGAAGCTGAACAGAGAGGACCTGCTGCGGAA
GCAGCGGACCTTCGACAACGGCAGCATCCCCCACCAGATCCACCTGGGAG
AGCTGCACGCCATTCTGCGGCGGCAGGAAGATTTTTACCCATTCCTGAAG -continued

```
GACAACCGGGAAAAGATCGAGAAGATCCTGACCTTCCGCATCCCCTACTA
CGTGGGCCCTCTGGCCAGGGGAAACAGCAGATTCGCCTGGATGACCAGAA
AGAGCGAGGAAACCATCACCCCCTGGAACTTCGAGGAAGTGGTGGACAAG
GGCGCTTCCGCCCAGAGCTTCATCGAGCGGATGACCAACTTCGATAAGAA
CCTGCCCAACGAGAAGGTGCTGCCCAAGCACAGCCTGCTGTACGAGTACT
TCACCGTGTATAACGAGCTGACCAAAGTGAAATACGTGACCGAGGGAATG
AGAAAGCCCGCCTTCCTGAGCGGCGAGCAGAAAAAGGCCATCGTGGACCT
GCTGTTCAAGACCAACCGGAAAGTGACCGTGAAGCAGCTGAAAGAGGACT
ACTTCAAGAAAATCGAGTGCTTCGACTCCGTGGAAATCTCCGGCGTGGAA
GATCGGTTCAACGCCTCCCTGGGCACATACCACGATCTGCTGAAAATTAT
CAAGGACAAGGACTTCCTGGACAATGAGGAAAACGAGGACATTCTGGAAG
ATATCGTGCTGACCCTGACACTGTTTGAGGACAGAGAGATGATCGAGGAA
CGGCTGAAAACCTATGCCCACCTGTTCGACGACAAAGTGATGAAGCAGCT
GAAGCGGCGGAGATACACCGGCTGGGGCAGGCTGAGCCGGAAGCTGATCA
ACGGCATCCGGGACAAGCAGTCCGGCAAGACAATCCTGGATTTCCTGAAG
TCCGACGGCTTCGCCAACAGAAACTTCATGCAGCTGATCCACGACGACAG
CCTGACCTTTAAAGAGGACATCCAGAAAGCCCAGGTGTCCGGCCAGGGCG
ATAGCCTGCACGAGCACATTGCCAATCTGGCCGGCAGCCCCGCCATTAAG
AAGGGCATCCTGCAGACAGTGAAGGTGGTGGACGAGCTCGTGAAAGTGAT
GGGCCGGCACAAGCCCGAGAACATCGTGATCGccATGGCCAGAGAGAACC
AGACCACCCAGAAGGGACAGAAGAACAGCCGCGAGAGAATGAAGCGGATC
GAAGAGGGCATCAAAGAGCTGGGCAGCCAGATCCTGAAAGAACACCCCGT
GGAAAACACCCAGCTGCAGAACGAGAAGCTGTACCTGTACTACCTGCAGA
ATGGGCGGGATATGTACGTGGACCAGGAACTGGACATCAACCGGCTGTCC
GACTACGATGTGGACCATATCGTGCCTCAGAGCTTTCTGAAGGACGACTC
CATCGACAACAAGGTGCTGACCAGAAGCGACAAGAACCGGGGCAAGAGCG
ACAACGTGCCCTCCGAAGAGGTCGTGAAGAAGATGAAGAACTACTGGCGG
CAGCTGCTGAACGCCAAGCTGATTACCCAGAGAAAGTTCGACAATCTGAC
CAAGGCCGAGAGAGGCGGCCTGAGCGAACTGGATAAGGCCGGCTTCATCA
AGAGACAGCTGGTGGAAACCCGGCAGATCACAAAGCACGTGGCACAGATC
CTGGACTCCCGGATGAACACTAAGTACGACGAGAATGACAAGCTGATCCG
GGAAGTGAAAGTGATCACCCTGAAGTCCAAGCTGGTGTCCGATTTCCGGA
AGGATTTCCAGTTTTACAAAGTGCGCGAGATCAACAACTACCACCACGCC
CACGACGCCTACCTGAACGCCGTCGTGGGAACCGCCCTGATCAAAAAGTA
CCCTAAGCTGGAAAGCGAGTTCGTGTACGGCGACTACAAGGTGTACGACG
TGCGGAAGATGATCGCCAAGAGCGAGCAGGAAATCGGCAAGGCTACCGCC
AAGTACTTCTTCTACAGCAACATCATGAACTTTTTCAAGACCGAGATTAC
CCTGGCCAACGGCGAGATCCGGAAGCGGCCTCTGATCGAGACAAACGGCG
AAACCGGGGAGATCGTGTGGGATAAGGGCCGGGATTTTGCCACCGTGCGG
AAAGTGCTGAGCATGCCCCAAGTGAATATCGTGAAAAAGACCGAGGTGCA
```

```
GACAGGCGGCTTCAGCAAAGAGTCTATCCTGCCCAAGAGGAACAGCGATA
AGCTGATCGCCAGAAAGAAGGACTGGGACCCTAAGAAGTACGGCGGCTTC
GACAGCCCCACCGTGGCCTATTCTGTGCTGGTGGTGGCCAAAGTGGAAAA
GGGCAAGTCCAAGAAACTGAAGAGTGTGAAAGAGCTGCTGGGGATCACCA
TCATGGAAAGAAGCAGCTTCGAGAAGAATCCCATCGACTTTCTGGAAGCC
AAGGGCTACAAAGAAGTGAAAAAGGACCTGATCATCAAGCTGCCTAAGTA
CTCCCTGTTCGAGCTGGAAAACGGCCGGAAGAGAATGCTGGCCTCTGCCG
GCGAACTGCAGAAGGGAAACGAACTGGCCCTGCCCTCCAAATATGTGAAC
TTCCTGTACCTGGCCAGCCACTATGAGAAGCTGAAGGGCTCCCCCGAGGA
TAATGAGCAGAAACAGCTGTTTGTGGAACAGCACAAGCACTACCTGGACG
AGATCATCGAGCAGATCAGCGAGTTCTCCAAGAGAGTGATCCTGGCCGAC
GCTAATCTGGACAAAGTGCTGTCCGCCTACAACAAGCACCGGGATAAGCC
CATCAGAGAGCAGGCCGAGAATATCATCCACCTGTTTACCCTGACCAATC
TGGGAGCCCCTGCCGCCTTCAAGTACTTTGACACCACCATCGACCGGAAG
AGGTACACCAGCACCAAAGAGGTGCTGGACGCCACCCTGATCCACCAGAG
CATCACCGGCCTGTACGAGACACGGATCGACCTGTCTCAGCTGGGAGGCG
ACAAAAGGCCGGCGGCCACGAAAAAGGCCGGCCAGGCAAAAAAGAAAAAG
taa >NLS-H982A-NLS                                    (SEQ ID NO: 111)
ATGGCCCCAAAGAAGAAGCGGAAGGTCGGTATCCACGGAGTCCCAGCAGC
CGACAAGAAGTACAGCATCGGCCTGGACATCGGCACCAACTCTGTGGGCT
GGGCCGTGATCACCGACGAGTACAAGGTGCCCAGCAAGAAATTCAAGGTG
CTGGGCAACACCGACCGGCACAGCATCAAGAAGAACCTGATCGGAGCCCT
GCTGTTCGACAGCGGCGAAACAGCCGAGGCCACCCGGCTGAAGAGAACCG
CCAGAAGAAGATACACCAGACGGAAGAACCGGATCTGCTATCTGCAAGAG
ATCTTCAGCAACGAGATGGCCAAGGTGGACGACAGCTTCTTCCACAGACT
GGAAGAGTCCTTCCTGGTGGAAGAGGATAAGAAGCACGAGCGGCACCCCA
TCTTCGGCAACATCGTGGACGAGGTGGCCTACCACGAGAAGTACCCCACC
ATCTACCACCTGAGAAAGAAACTGGTGGACAGCACCGACAAGGCCGACCT
GCGGCTGATCTATCTGGCCCTGGCCCACATGATCAAGTTCCGGGGCCACT
TCCTGATCGAGGGCGACCTGAACCCCGACAACAGCGACGTGGACAAGCTG
TTCATCCAGCTGGTGCAGACCTACAACCAGCTGTTCGAGGAAAACCCCAT
CAACGCCAGCGGCGTGGACGCCAAGGCCATCCTGTCTGCCAGACTGAGCA
AGAGCAGACGGCTGGAAAATCTGATCGCCCAGCTGCCCGGCGAGAAGAAG
AATGGCCTGTTCGGAAACCTGATTGCCCTGAGCCTGGGCCTGACCCCCAA
CTTCAAGAGCAACTTCGACCTGGCCGAGGATGCCAAACTGCAGCTGAGCA
AGGACACCTACGACGACGACCTGGACAACCTGCTGGCCCAGATCGGCGAC
CAGTACGCCGACCTGTTTCTGGCCGCCAAGAACCTGTCCGACGCCATCCT
GCTGAGCGACATCCTGAGAGTGAACACCGAGATCACCAAGGCCCCCCTGA
GCGCCTCTATGATCAAGAGATACGACGAGCACCACCAGGACCTGACCCTG
CTGAAAGCTCTCGTGCGGCAGCAGCTGCCTGAGAAGTACAAAGAGATTTT
```

```
CTTCGACCAGAGCAAGAACGGCTACGCCGGCTACATTGACGGCGGAGCCA
GCCAGGAAGAGTTCTACAAGTTCATCAAGCCCATCCTGGAAAAGATGGAC
GGCACCGAGGAACTGCTCGTGAAGCTGAACAGAGAGGACCTGCTGCGGAA
GCAGCGGACCTTCGACAACGGCAGCATCCCCCACCAGATCCACCTGGGAG
AGCTGCACGCCATTCTGCGGCGGCAGGAAGATTTTTACCCATTCCTGAAG
GACAACCGGGAAAAGATCGAGAAGATCCTGACCTTCCGCATCCCCTACTA
CGTGGGCCCTCTGGCCAGGGGAAACAGCAGATTCGCCTGGATGACCAGAA
AGAGCGAGGAAACCATCACCCCCTGGAACTTCGAGGAAGTGGTGGACAAG
GGCGCTTCCGCCCAGAGCTTCATCGAGCGGATGACCAACTTCGATAAGAA
CCTGCCCAACGAGAAGGTGCTGCCCAAGCACAGCCTGCTGTACGAGTACT
TCACCGTGTATAACGAGCTGACCAAAGTGAAATACGTGACCGAGGGAATG
AGAAAGCCCGCCTTCCTGAGCGGCGAGCAGAAAAAGGCCATCGTGGACCT
GCTGTTCAAGACCAACCGGAAAGTGACCGTGAAGCAGCTGAAAGAGGACT
ACTTCAAGAAAATCGAGTGCTTCGACTCCGTGGAAATCTCCGGCGTGGAA
GATCGGTTCAACGCCTCCCTGGGCACATACCACGATCTGCTGAAAATTAT
CAAGGACAAGGACTTCCTGGACAATGAGGAAAACGAGGACATTCTGGAAG
ATATCGTGCTGACCCTGACACTGTTTGAGGACAGAGAGATGATCGAGGAA
CGGCTGAAAACCTATGCCCACCTGTTCGACGACAAAGTGATGAAGCAGCT
GAAGCGGCGGAGATACACCGGCTGGGGCAGGCTGAGCCGGAAGCTGATCA
ACGGCATCCGGGACAAGCAGTCCGGCAAGACAATCCTGGATTTCCTGAAG
TCCGACGGCTTCGCCAACAGAAACTTCATGCAGCTGATCCACGACGACAG
CCTGACCTTTAAAGAGGACATCCAGAAAGCCCAGGTGTCCGGCCAGGGCG
ATAGCCTGCACGAGCACATTGCCAATCTGGCCGGCAGCCCCGCCATTAAG
AAGGGCATCCTGCAGACAGTGAAGGTGGTGGACGAGCTCGTGAAAGTGAT
GGGCCGGCACAAGCCCGAGAACATCGTGATCGAAATGGCCAGAGAGAACC
AGACCACCCAGAAGGGACAGAAGAACAGCCGCGAGAGAATGAAGCGGATC
GAAGAGGGCATCAAAGAGCTGGGCAGCCAGATCCTGAAAGAACACCCCGT
GGAAAACACCCAGCTGCAGAACGAGAAGCTGTACCTGTACTACCTGCAGA
ATGGGCGGGATATGTACGTGGACCAGGAACTGGACATCAACCGGCTGTCC
GACTACGATGTGGACCATATCGTGCCTCAGAGCTTTCTGAAGGACGACTC
CATCGACAACAAGGTGCTGACCAGAAGCGACAAGAACCGGGGCAAGAGCG
ACAACGTGCCCTCCGAAGAGGTCGTGAAGAAGATGAAGAACTACTGGCGG
CAGCTGCTGAACGCCAAGCTGATTACCCAGAGAAAGTTCGACAATCTGAC
CAAGGCCGAGAGAGGCGGCCTGAGCGAACTGGATAAGGCCGGCTTCATCA
AGAGACAGCTGGTGGAAACCCGGCAGATCACAAAGCACGTGGCACAGATC
CTGGACTCCCGGATGAACACTAAGTACGACGAGAATGACAAGCTGATCCG
GGAAGTGAAAGTGATCACCCTGAAGTCCAAGCTGGTGTCCGATTTCCGGA
AGGATTTCCAGTTTTACAAAGTGCGCGAGATCAACAACTACgccCACGCC
CACGACGCCTACCTGAACGCCGTCGTGGGAACCGCCCTGATCAAAAAGTA
CCCTAAGCTGGAAAGCGAGTTCGTGTACGGCGACTACAAGGTGTACGACG
TGCGGAAGATGATCGCCAAGAGCGAGCAGGAAATCGGCAAGGCTACCGCC
AAGTACTTCTTCTACAGCAACATCATGAACTTTTTCAAGACCGAGATTAC
CCTGGCCAACGGCGAGATCCGGAAGCGGCCTCTGATCGAGACAAACGGCG
AAACCGGGGAGATCGTGTGGGATAAGGGCCGGGATTTTGCCACCGTGCGG
AAAGTGCTGAGCATGCCCCAAGTGAATATCGTGAAAAAGACCGAGGTGCA
GACAGGCGGCTTCAGCAAAGAGTCTATCCTGCCCAAGAGGAACAGCGATA
AGCTGATCGCCAGAAAGAAGGACTGGGACCCTAAGAAGTACGGCGGCTTC
GACAGCCCCACCGTGGCCTATTCTGTGCTGGTGGTGGCCAAAGTGGAAAA
GGGCAAGTCCAAGAAACTGAAGAGTGTGAAAGAGCTGCTGGGGATCACCA
TCATGGAAAGAAGCAGCTTCGAGAAGAATCCCATCGACTTTCTGGAAGCC
AAGGGCTACAAAGAAGTGAAAAAGGACCTGATCATCAAGCTGCCTAAGTA
CTCCCTGTTCGAGCTGGAAAACGGCCGGAAGAGAATGCTGGCCTCTGCCG
GCGAACTGCAGAAGGGAAACGAACTGGCCCTGCCCTCCAAATATGTGAAC
TTCCTGTACCTGGCCAGCCACTATGAGAAGCTGAAGGGCTCCCCCGAGGA
TAATGAGCAGAAACAGCTGTTTGTGGAACAGCACAAGCACTACCTGGACG
AGATCATCGAGCAGATCAGCGAGTTCTCCAAGAGAGTGATCCTGGCCGAC
GCTAATCTGGACAAAGTGCTGTCCGCCTACAACAAGCACCGGGATAAGCC
CATCAGAGAGCAGGCCGAGAATATCATCCACCTGTTTACCCTGACCAATC
TGGGAGCCCCTGCCGCCTTCAAGTACTTTGACACCACCATCGACCGGAAG
AGGTACACCAGCACCAAAGAGGTGCTGGACGCCACCCTGATCCACCAGAG
CATCACCGGCCTGTACGAGACACGGATCGACCTGTCTCAGCTGGGAGGCG
ACAAAAGGCCGGCGGCCACGAAAAAGGCCGGCCAGGCAAAAAAGAAAAAG
taa >NLS-H983A-NLS
(SEQ ID NO: 112)
ATGGCCCCAAAGAAGAAGCGGAAGGTCGGTATCCACGGAGTCCCAGCAGC
CGACAAGAAGTACAGCATCGGCCTGGACATCGGCACCAACTCTGTGGGCT
GGGCCGTGATCACCGACGAGTACAAGGTGCCCAGCAAGAAATTCAAGGTG
CTGGGCAACACCGACCGGCACAGCATCAAGAAGAACCTGATCGGAGCCCT
GCTGTTCGACAGCGGCGAAACAGCCGAGGCCACCCGGCTGAAGAGAACCG
CCAGAAGAAGATACACCAGACGGAAGAACCGGATCTGCTATCTGCAAGAG
ATCTTCAGCAACGAGATGGCCAAGGTGGACGACAGCTTCTTCCACAGACT
GGAAGAGTCCTTCCTGGTGGAAGAGGATAAGAAGCACGAGCGGCACCCCA
TCTTCGGCAACATCGTGGACGAGGTGGCCTACCACGAGAAGTACCCCACC
ATCTACCACCTGAGAAAGAAACTGGTGGACAGCACCGACAAGGCCGACCT
GCGGCTGATCTATCTGGCCCTGGCCCACATGATCAAGTTCCGGGGCCACT
TCCTGATCGAGGGCGACCTGAACCCCGACAACAGCGACGTGGACAAGCTG
TTCATCCAGCTGGTGCAGACCTACAACCAGCTGTTCGAGGAAAACCCCAT
CAACGCCAGCGGCGTGGACGCCAAGGCCATCCTGTCTGCCAGACTGAGCA
AGAGCAGACGGCTGGAAAATCTGATCGCCCAGCTGCCCGGCGAGAAGAAG
AATGGCCTGTTCGGAAACCTGATTGCCCTGAGCCTGGGCCTGACCCCCAA
CTTCAAGAGCAACTTCGACCTGGCCGAGGATGCCAAACTGCAGCTGAGCA
```

```
AGGACACCTACGACGACGACCTGGACAACCTGCTGGCCCAGATCGGCGAC
CAGTACGCCGACCTGTTTCTGGCCGCCAAGAACCTGTCCGACGCCATCCT
GCTGAGCGACATCCTGAGAGTGAACACCGAGATCACCAAGGCCCCCCTGA
GCGCCTCTATGATCAAGAGATACGACGAGCACCACCAGGACCTGACCCTG
CTGAAAGCTCTCGTGCGGCAGCAGCTGCCTGAGAAGTACAAAGAGATTTT
CTTCGACCAGAGCAAGAACGGCTACGCCGGCTACATTGACGGCGGAGCCA
GCCAGGAAGAGTTCTACAAGTTCATCAAGCCCATCCTGGAAAAGATGGAC
GGCACCGAGGAACTGCTCGTGAAGCTGAACAGAGAGGACCTGCTGCGGAA
GCAGCGGACCTTCGACAACGGCAGCATCCCCCACCAGATCCACCTGGGAG
AGCTGCACGCCATTCTGCGGCGGCAGGAAGATTTTTACCCATTCCTGAAG
GACAACCGGGAAAAGATCGAGAAGATCCTGACCTTCCGCATCCCCTACTA
CGTGGGCCCTCTGGCCAGGGGAAACAGCAGATTCGCCTGGATGACCAGAA
AGAGCGAGGAAACCATCACCCCCTGGAACTTCGAGGAAGTGGTGGACAAG
GGCGCTTCCGCCCAGAGCTTCATCGAGCGGATGACCAACTTCGATAAGAA
CCTGCCCAACGAGAAGGTGCTGCCCAAGCACAGCCTGCTGTACGAGTACT
TCACCGTGTATAACGAGCTGACCAAAGTGAAATACGTGACCGAGGGAATG
AGAAAGCCCGCCTTCCTGAGCGGCGAGCAGAAAAAGGCCATCGTGGACCT
GCTGTTCAAGACCAACCGGAAAGTGACCGTGAAGCAGCTGAAAGAGGACT
ACTTCAAGAAAATCGAGTGCTTCGACTCCGTGGAAATCTCCGGCGTGGAA
GATCGGTTCAACGCCTCCCTGGGCACATACCACGATCTGCTGAAAATTAT
CAAGGACAAGGACTTCCTGGACAATGAGGAAAACGAGGACATTCTGGAAG
ATATCGTGCTGACCCTGACACTGTTTGAGGACAGAGAGATGATCGAGGAA
CGGCTGAAAACCTATGCCCACCTGTTCGACGACAAAGTGATGAAGCAGCT
GAAGCGGCGGAGATACACCGGCTGGGGCAGGCTGAGCCGGAAGCTGATCA
ACGGCATCCGGGACAAGCAGTCCGGCAAGACAATCCTGGATTTCCTGAAG
TCCGACGGCTTCGCCAACAGAAACTTCATGCAGCTGATCCACGACGACAG
CCTGACCTTTAAAGAGGACATCCAGAAAGCCCAGGTGTCCGGCCAGGGCG
ATAGCCTGCACGAGCACATTGCCAATCTGGCCGGCAGCCCCGCCATTAAG
AAGGGCATCCTGCAGACAGTGAAGGTGGTGGACGAGCTCGTGAAAGTGAT
GGGCCGGCACAAGCCCGAGAACATCGTGATCGAAATGGCCAGAGAGAACC
AGACCACCCAGAAGGGACAGAAGAACAGCCGCGAGAGAATGAAGCGGATC
GAAGAGGGCATCAAAGAGCTGGGCAGCCAGATCCTGAAAGAACACCCCGT
GGAAAACACCCAGCTGCAGAACGAGAAGCTGTACCTGTACTACCTGCAGA
ATGGGCGGGATATGTACGTGGACCAGGAACTGGACATCAACCGGCTGTCC
GACTACGATGTGGACCATATCGTGCCTCAGAGCTTTCTGAAGGACGACTC
CATCGACAACAAGGTGCTGACCAGAAGCGACAAGAACCGGGGCAAGAGCG
ACAACGTGCCCTCCGAAGAGGTCGTGAAGAAGATGAAGAACTACTGGCGG
CAGCTGCTGAACGCCAAGCTGATTACCCAGAGAAAGTTCGACAATCTGAC
CAAGGCCGAGAGAGGCGGCCTGAGCGAACTGGATAAGGCCGGCTTCATCA
AGAGACAGCTGGTGGAAACCCGGCAGATCACAAAGCACGTGGCACAGATC

CTGGACTCCCGGATGAACACTAAGTACGACGAGAATGACAAGCTGATCCG
GGAAGTGAAAGTGATCACCCTGAAGTCCAAGCTGGTGTCCGATTTCCGGA
AGGATTTCCAGTTTTACAAAGTGCGCGAGATCAACAACTACCACgccGCC
CACGACGCCTACCTGAACGCCGTCGTGGGAACCGCCCTGATCAAAAAGTA
CCCTAAGCTGGAAAGCGAGTTCGTGTACGGCGACTACAAGGTGTACGACG
TGCGGAAGATGATCGCCAAGAGCGAGCAGGAAATCGGCAAGGCTACCGCC
AAGTACTTCTTCTACAGCAACATCATGAACTTTTTCAAGACCGAGATTAC
CCTGGCCAACGGCGAGATCCGGAAGCGGCCTCTGATCGAGACAAACGGCG
AAACCGGGGAGATCGTGTGGGATAAGGGCCGGGATTTTGCCACCGTGCGG
AAAGTGCTGAGCATGCCCCAAGTGAATATCGTGAAAAAGACCGAGGTGCA
GACAGGCGGCTTCAGCAAAGAGTCTATCCTGCCCAAGAGGAACAGCGATA
AGCTGATCGCCAGAAAGAAGGACTGGGACCCTAAGAAGTACGGCGGCTTC
GACAGCCCCACCGTGGCCTATTCTGTGCTGGTGGTGGCCAAAGTGGAAAA
GGGCAAGTCCAAGAAACTGAAGAGTGTGAAAGAGCTGCTGGGGATCACCA
TCATGGAAAGAAGCAGCTTCGAGAAGAATCCCATCGACTTTCTGGAAGCC
AAGGGCTACAAAGAAGTGAAAAAGGACCTGATCATCAAGCTGCCTAAGTA
CTCCCTGTTCGAGCTGGAAAACGGCCGGAAGAGAATGCTGGCCTCTGCCG
GCGAACTGCAGAAGGGAAACGAACTGGCCCTGCCCTCCAAATATGTGAAC
TTCCTGTACCTGGCCAGCCACTATGAGAAGCTGAAGGGCTCCCCCGAGGA
TAATGAGCAGAAACAGCTGTTTGTGGAACAGCACAAGCACTACCTGGACG
AGATCATCGAGCAGATCAGCGAGTTCTCCAAGAGAGTGATCCTGGCCGAC
GCTAATCTGGACAAAGTGCTGTCCGCCTACAACAAGCACCGGGATAAGCC
CATCAGAGAGCAGGCCGAGAATATCATCCACCTGTTTACCCTGACCAATC
TGGGAGCCCCTGCCGCCTTCAAGTACTTTGACACCACCATCGACCGGAAG
AGGTACACCAGCACCAAAGAGGTGCTGGACGCCACCCTGATCCACCAGAG
CATCACCGGCCTGTACGAGACACGGATCGACCTGTCTCAGCTGGGAGGCG
ACAAAAGGCCGGCGGCCACGAAAAAGGCCGGCCAGGCAAAAAAGAAAAAG
taa >NLS-D986A-NLS
                                      (SEQ ID NO: 113)
ATGGCCCCAAAGAAGAAGCGGAAGGTCGGTATCCACGGAGTCCCAGCAGC
CGACAAGAAGTACAGCATCGGCCTGGACATCGGCACCAACTCTGTGGGCT
GGGCCGTGATCACCGACGAGTACAAGGTGCCCAGCAAGAAATTCAAGGTG
CTGGGCAACACCGACCGGCACAGCATCAAGAAGAACCTGATCGGAGCCCT
GCTGTTCGACAGCGGCGAAACAGCCGAGGCCACCCGGCTGAAGAGAACCG
CCAGAAGAAGATACACCAGACGGAAGAACCGGATCTGCTATCTGCAAGAG
ATCTTCAGCAACGAGATGGCCAAGGTGGACGACAGCTTCTTCCACAGACT
GGAAGAGTCCTTCCTGGTGGAAGAGGATAAGAAGCACGAGCGGCACCCCA
TCTTCGGCAACATCGTGGACGAGGTGGCCTACCACGAGAAGTACCCCACC
ATCTACCACCTGAGAAAGAAACTGGTGGACAGCACCGACAAGGCCGACCT
GCGGCTGATCTATCTGGCCCTGGCCCACATGATCAAGTTCCGGGGCCACT
TCCTGATCGAGGGCGACCTGAACCCCGACAACAGCGACGTGGACAAGCTG
```

```
TTCATCCAGCTGGTGCAGACCTACAACCAGCTGTTCGAGGAAAACCCCAT
CAACGCCAGCGGCGTGGACGCCAAGGCCATCCTGTCTGCCAGACTGAGCA
AGAGCAGACGGCTGGAAAATCTGATCGCCCAGCTGCCCGGCGAGAAGAAG
AATGGCCTGTTCGGAAACCTGATTGCCCTGAGCCTGGGCCTGACCCCCAA
CTTCAAGAGCAACTTCGACCTGGCCGAGGATGCCAAACTGCAGCTGAGCA
AGGACACCTACGACGACGACCTGGACAACCTGCTGGCCCAGATCGGCGAC
CAGTACGCCGACCTGTTTCTGGCCGCCAAGAACCTGTCCGACGCCATCCT
GCTGAGCGACATCCTGAGAGTGAACACCGAGATCACCAAGGCCCCCCTGA
GCGCCTCTATGATCAAGAGATACGACGAGCACCACCAGGACCTGACCCTG
CTGAAAGCTCTCGTGCGGCAGCAGCTGCCTGAGAAGTACAAAGAGATTTT
CTTCGACCAGAGCAAGAACGGCTACGCCGGCTACATTGACGGCGGAGCCA
GCCAGGAAGAGTTCTACAAGTTCATCAAGCCCATCCTGGAAAAGATGGAC
GGCACCGAGGAACTGCTCGTGAAGCTGAACAGAGAGGACCTGCTGCGGAA
GCAGCGGACCTTCGACAACGGCAGCATCCCCCACCAGATCCACCTGGGAG
AGCTGCACGCCATTCTGCGGCGGCAGGAAGATTTTTACCCATTCCTGAAG
GACAACCGGGAAAAGATCGAGAAGATCCTGACCTTCCGCATCCCCTACTA
CGTGGGCCCTCTGGCCAGGGGAAACAGCAGATTCGCCTGGATGACCAGAA
AGAGCGAGGAAACCATCACCCCCTGGAACTTCGAGGAAGTGGTGGACAAG
GGCGCTTCCGCCCAGAGCTTCATCGAGCGGATGACCAACTTCGATAAGAA
CCTGCCCAACGAGAAGGTGCTGCCCAAGCACAGCCTGCTGTACGAGTACT
TCACCGTGTATAACGAGCTGACCAAAGTGAAATACGTGACCGAGGGAATG
AGAAAGCCCGCCTTCCTGAGCGGCGAGCAGAAAAAGGCCATCGTGGACCT
GCTGTTCAAGACCAACCGGAAAGTGACCGTGAAGCAGCTGAAAGAGGACT
ACTTCAAGAAAATCGAGTGCTTCGACTCCGTGGAAATCTCCGGCGTGGAA
GATCGGTTCAACGCCTCCCTGGGCACATACCACGATCTGCTGAAAATTAT
CAAGGACAAGGACTTCCTGGACAATGAGGAAAACGAGGACATTCTGGAAG
ATATCGTGCTGACCCTGACACTGTTTGAGGACAGAGAGATGATCGAGGAA
CGGCTGAAAACCTATGCCCACCTGTTCGACGACAAAGTGATGAAGCAGCT
GAAGCGGCGAGATACACCGGCTGGGGCAGGCTGAGCCGGAAGCTGATCA
ACGGCATCCGGGACAAGCAGTCCGGCAAGACAATCCTGGATTTCCTGAAG
TCCGACGGCTTCGCCAACAGAAACTTCATGCAGCTGATCCACGACGACAG
CCTGACCTTTAAAGAGGACATCCAGAAAGCCCAGGTGTCCGGCCAGGGCG
ATAGCCTGCACGAGCACATTGCCAATCTGGCCGGCAGCCCCGCCATTAAG
AAGGGCATCCTGCAGACAGTGAAGGTGGTGGACGAGCTCGTGAAAGTGAT
GGGCCGGCACAAGCCCGAGAACATCGTGATCGAAATGGCCAGAGAGAACC
AGACCACCCAGAAGGGACAGAAGAACAGCCGCGAGAGAATGAAGCGGATC
GAAGAGGGCATCAAAGAGCTGGGCAGCCAGATCCTGAAAGAACACCCCGT
GGAAAACACCCAGCTGCAGAACGAGAAGCTGTACCTGTACTACCTGCAGA
ATGGGCGGGATATGTACGTGGACCAGGAACTGGACATCAACCGGCTGTCC
GACTACGATGTGGACCATATCGTGCCTCAGAGCTTTCTGAAGGACGACTC

CATCGACAACAAGGTGCTGACCAGAAGCGACAAGAACCGGGGCAAGAGCG
ACAACGTGCCCTCCGAAGAGGTCGTGAAGAAGATGAAGAACTACTGGCGG
CAGCTGCTGAACGCCAAGCTGATTACCCAGAGAAAGTTCGACAATCTGAC
CAAGGCCGAGAGAGGCGGCCTGAGCGAACTGGATAAGGCCGGCTTCATCA
AGAGACAGCTGGTGGAAACCCGGCAGATCACAAAGCACGTGGCACAGATC
CTGGACTCCCGGATGAACACTAAGTACGACGAGAATGACAAGCTGATCCG
GGAAGTGAAAGTGATCACCCTGAAGTCCAAGCTGGTGTCCGATTTCCGGA
AGGATTTCCAGTTTTACAAAGTGCGCGAGATCAACAACTACCACCACGCC
CACGcCGCCTACCTGAACGCCGTCGTGGGAACCGCCCTGATCAAAAAGTA
CCCTAAGCTGGAAAGCGAGTTCGTGTACGGCGACTACAAGGTGTACGACG
TGCGGAAGATGATCGCCAAGAGCGAGCAGGAAATCGGCAAGGCTACCGCC
AAGTACTTCTTCTACAGCAACATCATGAACTTTTTCAAGACCGAGATTAC
CCTGGCCAACGGCGAGATCCGGAAGCGGCCTCTGATCGAGACAAACGGCG
AAACCGGGGAGATCGTGTGGGATAAGGGCCGGGATTTTGCCACCGTGCGG
AAAGTGCTGAGCATGCCCCAAGTGAATATCGTGAAAAAGACCGAGGTGCA
GACAGGCGGCTTCAGCAAAGAGTCTATCCTGCCCAAGAGGAACAGCGATA
AGCTGATCGCCAGAAAGAAGGACTGGGACCCTAAGAAGTACGGCGGCTTC
GACAGCCCCACCGTGGCCTATTCTGTGCTGGTGGTGGCCAAAGTGGAAAA
GGGCAAGTCCAAGAAACTGAAGAGTGTGAAAGAGCTGCTGGGGATCACCA
TCATGGAAAGAAGCAGCTTCGAGAAGAATCCCATCGACTTTCTGGAAGCC
AAGGGCTACAAAGAAGTGAAAAAGGACCTGATCATCAAGCTGCCTAAGTA
CTCCCTGTTCGAGCTGGAAAACGGCCGGAAGAGAATGCTGGCCTCTGCCG
GCGAACTGCAGAAGGGAAACGAACTGGCCCTGCCCTCCAAATATGTGAAC
TTCCTGTACCTGGCCAGCCACTATGAGAAGCTGAAGGGCTCCCCCGAGGA
TAATGAGCAGAAACAGCTGTTTGTGGAACAGCACAAGCACTACCTGGACG
AGATCATCGAGCAGATCAGCGAGTTCTCCAAGAGAGTGATCCTGGCCGAC
GCTAATCTGGACAAAGTGCTGTCCGCCTACAACAAGCACCGGGATAAGCC
CATCAGAGAGCAGGCCGAGAATATCATCCACCTGTTTACCCTGACCAATC
TGGGAGCCCCTGCCGCCTTCAAGTACTTTGACACCACCATCGACCGGAAG
AGGTACACCAGCACCAAAGAGGTGCTGGACGCCACCCTGATCCACCAGAG
CATCACCGGCCTGTACGAGACACGGATCGACCTGTCTCAGCTGGGAGGCG
ACAAAAGGCCGGCGGCCACGAAAAAGGCCGGCCAGGCAAAAAAGAAAAAG
```

Example 11: Truncating and Creating Chimeric Cas9s Based on *S. pyogenes* Cas9 Crystral Structure Herein FIGS. 27A-C pertain to truncating and creating chimeric Cas9s based on the herein crystal structure. These figures provide schematics illustrating A. SpCas9 mutants designed for mapping out essential functional domains of Cas9 for truncation of protein. B. chimeric Cas9s that contain sequences (regions in pink) from Cas9 from *S. thermophilus* CRISPR 1, *S. thermophilus* CRISPR 3, *Staphylococcus aureus*, *Neisseria meningiditis*, or other Cas9 orthologs. C. Designs for creating chemically inducible dimerization of SpCas9. The chemically inducible SpCas9 functions.

DNA sequences for chimeric Cas9s are optimized for human expression by GenScript and synthesized de novo. Chimeric Cas9 proteins can be constructed by cloning and ligating individual functional domains from Cas9 orthologs (i.e. by PCR-amplifying individual functional domains from a desired Cas9 ortholog, then assemblying the pieces together by either Gibson or Golden Gate-cloning). Additionally, a set of chemically-inducible Cas9s were constructed as two-component systems, where one portion of the Cas9 protein is fused to FKBP, and the remainder fused to FRB (e.g. FKBP-Cas9(amino acids 1-1098), FRB-Cas (1099-1368)). In absence of chemical induction, co-transfection of the two inducible Cas9 components have no catalytic activity, but the functional assembly of the components may be induced using Rapamycin [5 nM to 10 µM].

Example 12: Crystal Structure of Cas9 in Complex with Guide RNA and Target DNA

Cas9 is an RNA-guided nuclease from the microbial CRISPR-Cas system that can be targeted to specific genomic loci by single guide RNAs (sgRNAs). Applicants report the crystal structure of Streptococcus pyogenes Cas9 in complex with sgRNA and its target DNA at 2.4 Å resolution. The structure revealed a bilobed architecture composed of target recognition and nuclease lobes, accommodating a sgRNA: DNA duplex in a positively-charged groove at their interface. Whereas the recognition lobe is essential for sgRNA and DNA binding, the nuclease lobe contains the HNH and RuvC nuclease domains, which are properly positioned for the cleavage of complementary and non-complementary strands of the target DNA, respectively. This high-resolution structure and accompanying functional analyses elucidate the molecular mechanism of RNA-guided DNA targeting by Cas9, paving the way for rational design of new and versatile genome-editing technologies.

The CRISPR (clustered regularly interspaced palindromic repeat)-Cas system is a naturally occurring microbial adaptive immune system for defense against invading phages and other mobile genetic elements (Deveau et al., 2010; Horvath and Barrangou, 2010; Marraffini and Sontheimer, 2010; Terns and Terns, 2011). Three types (I-III) of CRISPR-Cas systems have been functionally identified across a wide range of microbial species (Barrangou et al., 2007; Brouns et al., 2008; Marraffini and Sontheimer, 2008), each containing a cluster of CRISPR-associated (Cas) genes and its corresponding CRISPR array. These characteristic CRISPR arrays consist of repetitive sequences (direct repeats, referred to as repeats) interspaced by short stretches of non-repetitive sequences (spacers) derived from short segments of foreign genetic material (protospacers). The CRISPR array is transcribed and processed into short CRISPR RNAs (crRNAs), which direct Cas proteins to the target nucleic acids, DNA or RNA, via Watson-Crick base pairing to facilitate the nucleic acid destruction.

Type I and III CRISPR systems utilize ensembles of Cas proteins in complex with crRNA to mediate recognition and subsequent degradation of target nucleic acids (Spilman et al., 2013; Wiedenheft et al., 2011). In contrast, the Type II CRISPR system achieves recognition and cleavage of the target DNA (Garneau et al., 2010) via a single enzyme called Cas9 (Sapranauskas et al., 2011) along with two non-coding RNAs, the crRNA and a trans-activating crRNA (tracrRNA) (Deltcheva et al., 2011). The crRNA hybridizes with the tracrRNA to form a crRNA:tracrRNA duplex, which is then loaded onto Cas9 to direct cleavage of cognate DNA sequences bearing appropriate protospacer adjacent motifs (PAM) (Mojica et al., 2009).

The Type II CRISPR system was the first to be adapted for facilitating genome editing in eukaryotic cells (Cong et al., 2013; Mali et al., 2013b). The Cas9 protein from Streptococcus pyogenes, along with a single guide RNA (sgRNA), a synthetic fusion of crRNA and minimal tracrRNA (Jinek et al., 2012), could be programmed to instruct cleavage of virtually any sequence preceding a 5'-NGG PAM sequence in mammalian cells (Cong et al., 2013; Mali et al., 2013b). This unprecedented flexibility has enabled a broad range of applications including rapid generation of genetically modified cells and animal models (Gratz et al., 2013; Hwang et al., 2013; Wang et al., 2013; Yang et al., 2013), and genome-scale genetic screening (Qi et al., 2013; Shalem et al., 2014; Wang et al., 2014).

However, despite brisk progress in the development of the Cas9 technology, the mechanism of how the Cas9-sgRNA complex recognizes and cleaves its target DNA remains to be elucidated. Up to date, biochemical analyses at the domain levels have enabled site-specific engineering to convert the native Cas9 into a DNA nicking enzyme (Gasiunas et al., 2012; Jinek et al., 2012; Sapranauskas et al., 2011) that facilitates homology-directed repair in eukaryotic cells (Cong et al., 2013; Mali et al., 2013b) and further cleaves DNA with improved specificity given appropriately paired sgRNAs (Mali et al., 2013a; Ran et al., 2013). Moreover, a catalytically inactive Cas9 can serve as a RNA-guided DNA-binding platform to target effector domains and modulate endogenous transcription (Gilbert et al., 2013; Konermann et al., 2013; Maeder et al., 2013; Perez-Pinera et al., 2013; Qi et al., 2013). These Cas9 engineering advances represent just the first steps of what is possible in fully realizing the potential of this flexible RNA-guided genome positioning system. A precise structural information on Cas9 will thus not only enhance the understanding of how this elegant RNA-guided microbial adaptive immune system functions, but also inform further improvements of Cas9 targeting specificity, simplification of in vitro and in vivo delivery, and engineering of Cas9 for novel functions and optimized features.

In this example, Applicants report the crystal structure of S. pyogenes Cas9 in complex with sgRNA and its target DNA at 2.4 Å resolution. This high-resolution structure along with functional analysis reveals the key functional interactions that integrate the guide RNA, target DNA, and Cas9 protein, paving the way towards enhancing Cas9 function as well as engineering novel applications.

Figure 37:
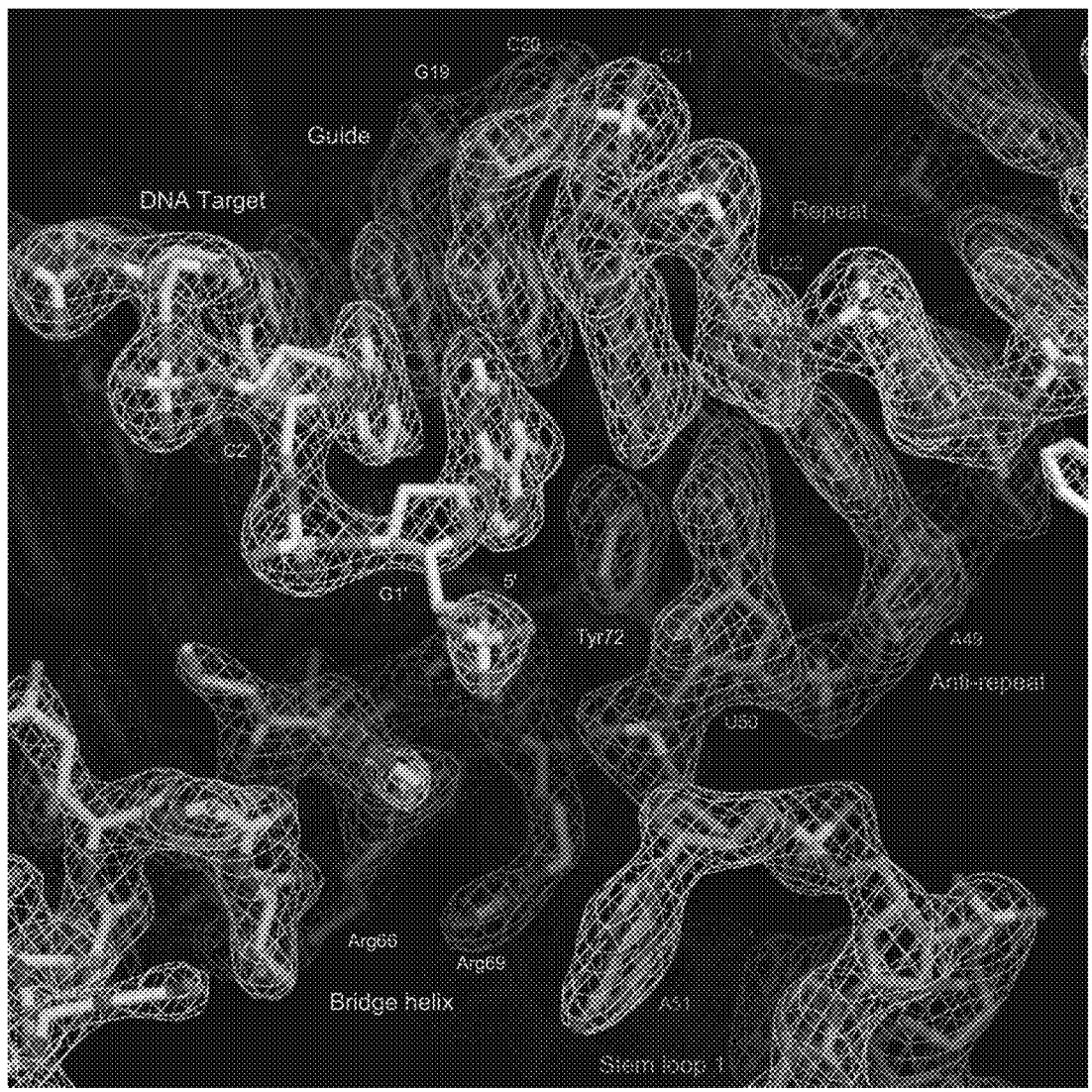
FIG. 37 shows Electron density map. The $2mF_O$-$DF_C$ electron density map around the three-way junction is shown as a gray mesh (contoured at 2.5σ).

Overall structure of the Cas9-sgRNA-DNA ternary complex: Applicants solved the crystal structure of full-length S. pyogenes Cas9 (residues 1-1368; D10A/C80L/C574E/H840A) in complex with a 98-nucleotide (nt) sgRNA and a 23-nt target DNA, at 2.4 Å resolution, by the SAD (single-wavelength anomalous dispersion) method using a SeMet-labeled protein (FIGS. 1, 37 and Table 1). To improve the solution behavior of Cas9, Applicants replaced two less conserved cysteine residues (Cys80 and Cys574) with leucine and glutamic acid, respectively. This C80L/C574E mutant retained the ability to efficiently cleave genomic DNA in human embryonic kidney 293FT (HEK293FT) cells, confirming that these mutations have no effects on Cas9 nuclease function (FIG. 38). Additionally, to prevent cleavage of the target DNA during crystallization, Applicants replaced the two catalytic residues, Asp10 from the RuvC domain and His840 from the HNH domain, with alanine.

TABLE 1

Data collection and refinement statistics

|  | Native Cas9 | SeMet Cas9 |
|---|---|---|
| Data collection | | |
| Beamline | SPring-8 BL32XU | SPring-8 BL41XU |
| Wavelength (Å) | 1.000 | 0.9791 |
| Space group | P1 | P1 |
| Cell dimensions | | |
| a, b, c (Å) | 76.7, 105.7, 126.8 | 76.2, 104.5, 125.5 |
| α, β, γ (°) | 97.7, 98.4, 100.3 | 97.0, 98.2, 101.1 |
| Resolution (Å) | 50-2.4 (2.54-2.4) | 50-2.6 (2.67-2.6) |
| $R_{sym}$ | 0.07 (1.53) | 0.167 (1.96) |
| I/σI | 22.53 (1.45) | 12.62 (1.44) |
| Completeness (%) | 98.2 (96.3) | 99.9 (99.9) |
| Redundancy | 7.93 (7.88) | 19.1 (15.9) |
| CC (1/2) | 0.999 (0.671) | 0.999 (0.736) |
| Refinement | | |
| Resolution (Å) | 50-2.4 | |
| No. reflections | 146,862 | |
| $R_{work}/R_{free}$ | 0.241/0.276 | |
| No. atoms | | |
| Protein | 19,021 | |
| Nucleic acid | 5,013 | |
| Solvent | 200 | |
| B-factors | | |
| Protein | 72.6 | |
| Nucleic acid | 72.6 | |
| Solvent | 53.3 | |
| R.m.s deviations | | |
| Bond lengths (Å) | 0.002 | |
| Bond angles (°) | 0.454 | |
| Ramachandran plot | | |
| Favored region | 96.8% | |
| Allowed region | 3.2% | |
| Outlier region | 0.0% | |

*Highest resolution shell is shown in parenthesis.

The crystallographic asymmetric unit contained two Cas9-sgRNA-DNA ternary complexes (Mol A and Mol B). Although there are conformational differences between the two complexes, sgRNA and DNA are recognized by Cas9 in a similar manner. Most notably, while the HNH domain in Mol A is connected with the RuvC domain by a disordered linker, the HNH domain in Mol B is not visible in the electron density map, indicating the flexible nature of the HNH domain. Thus, Applicants first describe the structural features of Mol A unless otherwise stated, and then discuss the structural differences between the two complexes, which suggest the conformational flexibility of Cas9.

The crystal structure revealed that Cas9 consists of two lobes, a recognition (REC) lobe and a nuclease (NUC) lobe (FIG. 30A-C). The REC lobe can be divided into three regions, a long α-helix referred to as Bridge helix (BH) (residues 60-93), the REC1 (residues 94-179 and 308-713), and REC2 (residues 180-307) domains (FIG. 30A-C). The NUC lobe consists of the RuvC (residues 1-59, 718-769, and 909-1098), HNH (residues 775-908), and PAM-interacting (PI) (residues 1099-1368) domains (FIG. 30A-C). The negatively-charged sgRNA:DNA hybrid duplex is accommodated in a positively-charged groove at the interface between the REC and NUC lobes (FIG. 30D). In the NUC lobe, the RuvC domain is assembled from the three split RuvC motifs (RuvC I-III), which interfaces with the PI domain to form a positively-charged surface that interacts with the 3' tail of the sgRNA (FIG. 30D). The HNH domain lies in between the RuvC motifs and forms only a few contacts with the rest of the protein.

Figure 39:
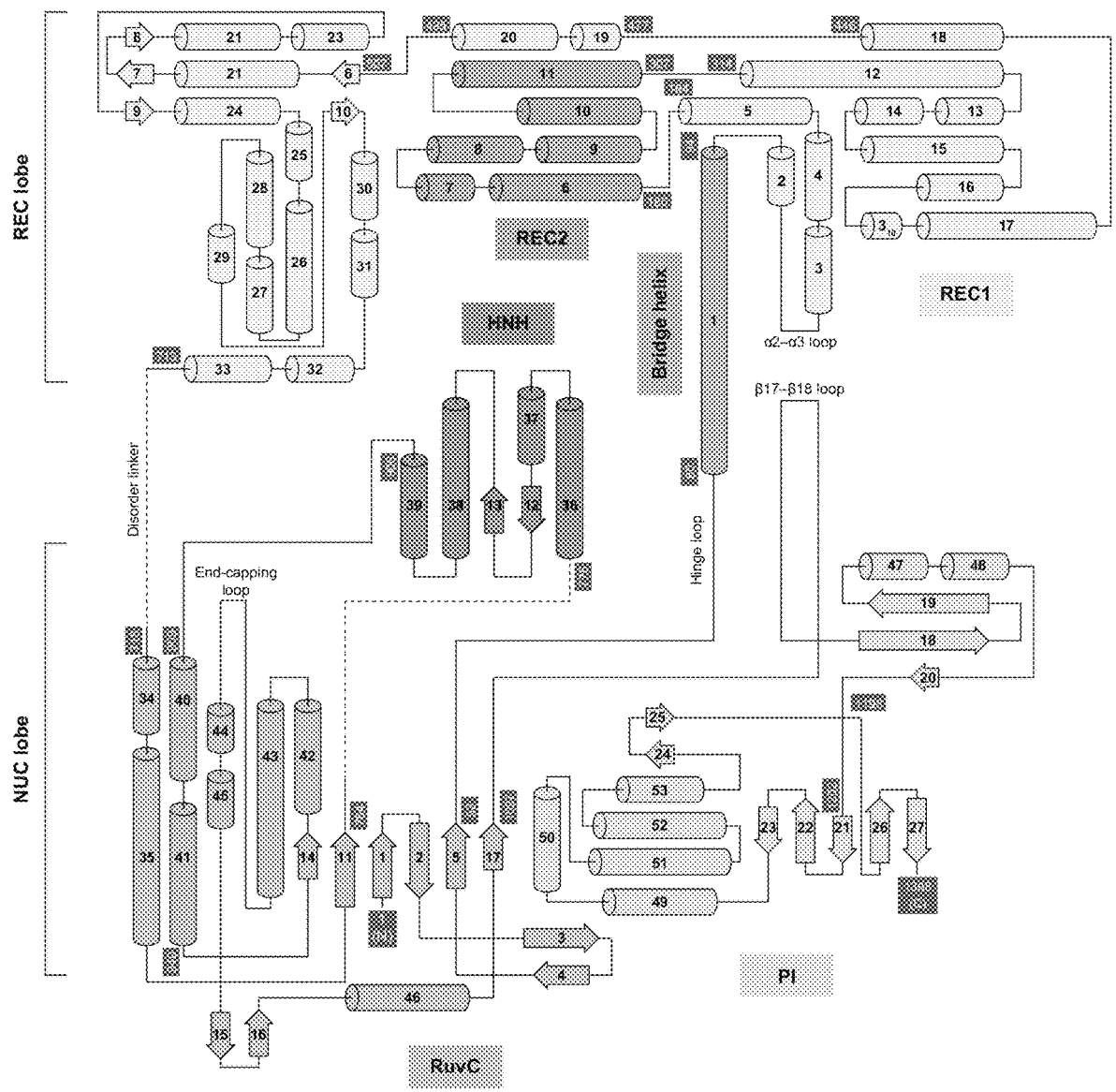
FIG. 39 shows a schematic drawing of the secondary structural elements of Cas9.

The REC lobe of Cas9 interacted with the repeat:anti-repeat duplex: The REC lobe comprises the REC1 and REC2 domains. REC1 adopted an elongated, α-helical structure comprising 26 α-helices (α2-α5 and α12-α33) and two β-sheets (β6/β10 and β7-β9), whereas REC2 adopted a six-helix bundle structure (α6-α11) (FIGS. 31A and 39). A Dali search (Holm and Rosenstrom, 2010) revealed that the REC lobe did not share structural similarity with other known proteins, indicating that it is a Cas9-specific functional domain.

Figure 40A:
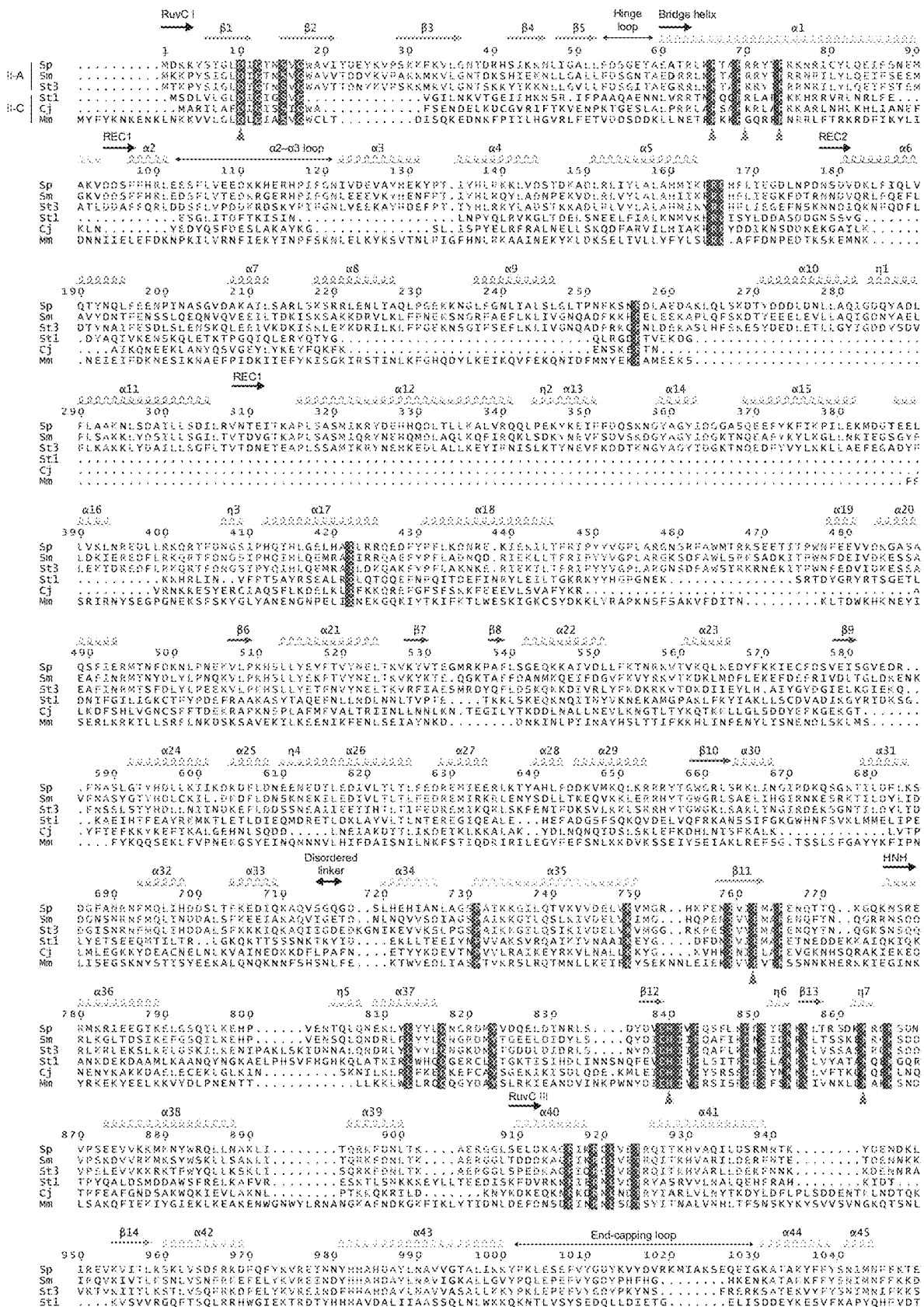
Figure 41:
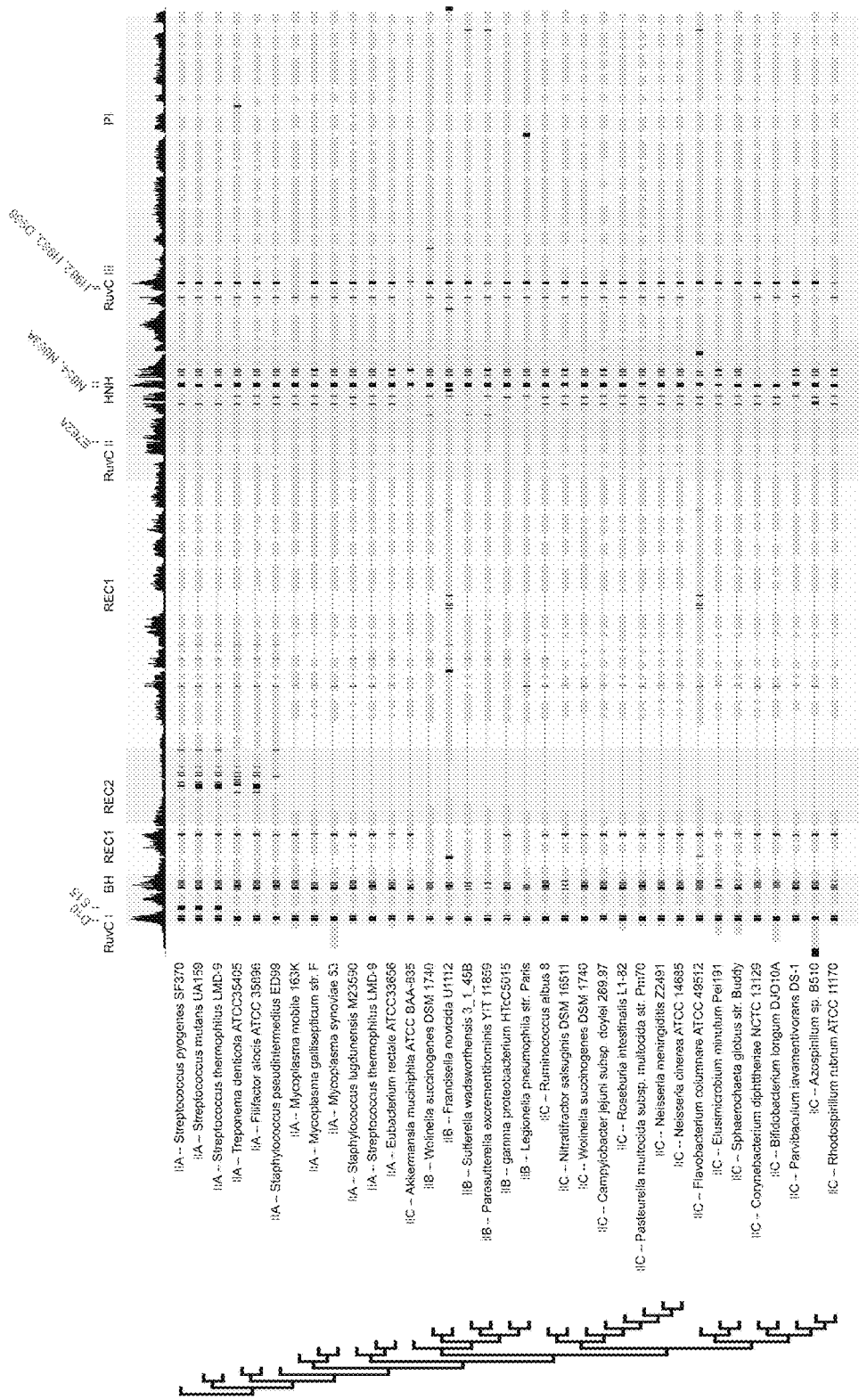
FIG. 41 shows the sequence alignment of Cas9 orthologs in families II-A, II-B and II-C. 35 Cas9 orthologs from families IIA, IIB and IIC are aligned (BLOSUM62) and clustered (Jukes-Cantor model Neighbor-Joining method, with *S. pyogenes* Cas9 as outgroup). Bars on top show conservation by amino acid. In each line, black bars show residues with at least 75% consensus, and gray bars non-conserved residues.

The REC lobe is one of the least conserved regions across the three families of Cas9 within the Type II CRISPR system (IIA, IIB and IIC) and many Cas9s contain significantly shorter REC lobes (FIGS. 40, 41). Applicants hypothesized that truncations in the REC lobe could be tolerated. As expected, and consistent with the observation that the REC2 domain does not contact the bound sgRNA:DNA hybrid duplex, a Cas9 mutant lacking the REC2 domain (Δ175-307) showed ~50% of the wild-type Cas9 activity (FIG. 31B), indicating that the REC2 domain is not critical for DNA cleavage. The lower cleavage efficiency may be attributed in part to the reduced levels of Cas9 (Δ175-307) expression relative to that of the wild-type protein (FIG. 31C). In striking contrast, deletion of the crRNA repeat-interacting region (Δ97-150) or tracrRNA anti-repeat-interacting region (Δ312-409) of the REC1 domain abolished DNA cleavage activity (FIG. 31B), indicating that the recognition of the repeat:anti-repeat duplex by the REC1 domain is critical for Cas9 function.

The PAM-interacting (PI) domain confers PAM specificity: The NUC lobe contains the PI domain, which adopts an elongated structure comprising seven α-helices (α47-α53), a three-stranded antiparallel β-sheet (β18-β20), a five-stranded antiparallel β-sheet (β21-β23, β26 and β27), and two-stranded antiparallel β-sheet (β24 and β25) (FIGS. 31D and 39). Similar to the REC lobe, the PI domain also represents a novel protein fold unique to the Cas9 family.

The locations of the bound complementary strand DNA and the active site of the RuvC domain in the present structure suggest that the PI domain is positioned to recognize the PAM sequence on the non-complementary strand of the target DNA. Applicants tested whether replacement of the *S. pyogenes* Cas9 (SpCas9; Cas9 in this study) PI domain with that of an orthologous Cas9 protein recognizing a different PAM would be sufficient to alter SpCas9 PAM specificity. The *Streptococcus thermophilus* CRISPR-3 Cas9 (St3Cas9) shares ~60% sequence identity with SpCas9; furthermore, their crRNA repeats and tracrRNAs are interchangeable (Fonfara et al., 2013). However, SpCas9 and St3Cas9 require different PAM sequences (5'-NGG for Cas9 and 5'-NGGNG for St3Cas9) for target DNA cleavage (Fonfara et al., 2013).

Applicants swapped the two PI domains to generate two chimeras, Sp-St3Cas9 (SpCas9 with the PI domain of St3Cas9) and St3-SpCas9 (St3Cas9 with the PI domain of SpCas9), and examined their cleavage activities for target DNA sequences bearing 5'-NGG PAM (5'-GGGCT) or 5'-NGGNG PAM (5'-GGGCG) (FIG. 31E). SpCas9 and St3-SpCas9, but not St3Cas9, cleaved the target DNA with 5'-NGG PAM (FIG. 31E), indicating that the PI domain of SpCas9 is required for the recognition of 5'-NGG PAM and is sufficient to alter the PAM recognition of St3Cas9. Sp-St3Cas9 retained cleavage activity for the target DNA with 5'-NGG PAM, albeit at a lower level than that of SpCas9 (FIG. 31E). Additionally, deletion of the PI domain (Δ1099-1368) abolished the cleavage activity (FIG. 31E), indicating that the PI domain is critical for Cas9 function. These results reveal that the PI domain is a major determinant of PAM specificity.

Figure 32A:
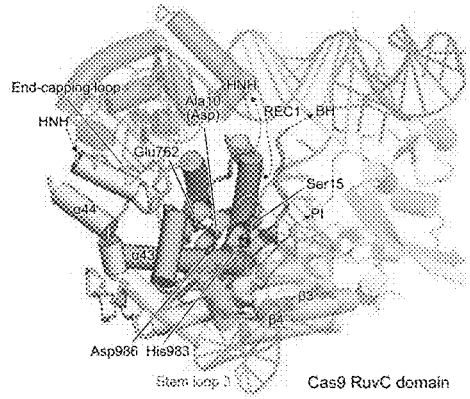
FIG. 32A-F shows the NUC lobe. Helices are shown as tubes and beta sheets are shown as arrows. (A) Structure of the RuvC domain. The core structure of the RNase H fold core is highlighted in cyan. The active-site residues are shown as stick models. (B) Structure of the *T. thermophilus* RuvC dimer in complex with a Holliday junction (PDB ID 4LD0). The two protomers are colored cyan and gray, respectively. (C) Sequence (top) (SEQ ID NO: 427) illustrates Cas9 nicking targets on opposite strands of DNA. Targets 1 and 2 are offset by a distance of 4-bp in between. Heatmap (bottom) shows the ability of each catalytic mutant to induce double- (with either sgRNA 1 or 2) or single-stranded breaks (only with both sgRNA together). Gray boxes: not assayed. (D) Indel formation by Cas9 nickases depends on off-set distance between sgRNA pairs (right panel). Off-set distance is defined as the number of base pairs between the PAM-distal (5') ends of the guide sequence of a given sgRNA pair (n=3, error bars show mean±S.E.M., N.D., not detectable). (E) Structure of the HNH domain. The core structure of the ββα-metal fold is highlighted in magenta. The active-site residues are shown as stick models. (F) Structure of the T4 Endo VII dimer in complex with a Holliday junction (PDB ID 2QNC). The two protomers are colored pink and gray, respectively, with the ββα-metal fold core highlighted in magenta. The bound $Mg^{2+}$ ion is shown as an orange sphere.
Figure 32B:
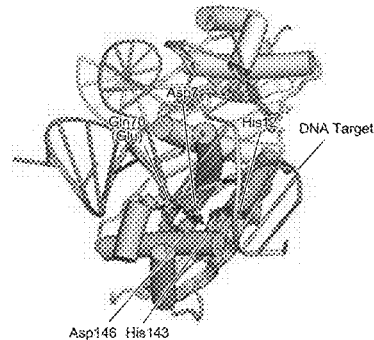
Figure 32C:
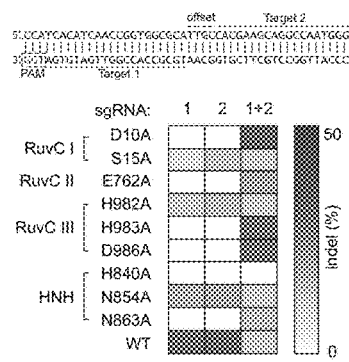
Figure 32D:
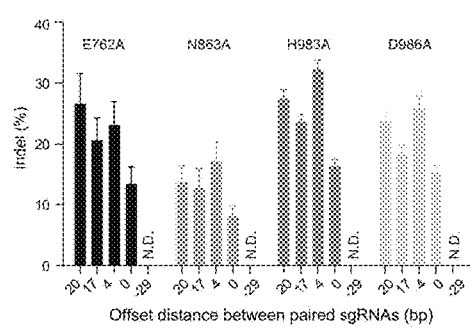

The RuvC domain targets the non-complementary strand DNA: The RuvC domain consists of a six-stranded mixed β-sheet (β1, β2, β5, β11, β14 and β17) flanked by α-helices (α34, α35 and α40-α46) and two additional two-stranded antiparallel β-sheets (β3/β4 and β15/β16) (FIGS. 32A and 39). It shares structural similarity with retroviral integrase superfamily members characterized by an RNase H fold, such as *Escherichia coli* RuvC (PDB code 1HJR, 13% identity, root-mean-square deviation (rmsd) of 3.4 Å for 123 equivalent Cα atoms) (Ariyoshi et al., 1994) and *Thermus thermophilus* RuvC (PDB code 4LD0, 17% identity, rmsd of 3.4 Å for 129 equivalent Cα atoms) (Ariyoshi et al., 1994) and *Thermus thermophilus* RuvC (PDB code 4LD0, 17% identity, rmsd of 3.4 Å for 129 equivalent Cα atoms) (Gorecka et al., 2013) (FIG. 32B). RuvC nucleases have four catalytic residues (e.g., Asp7, Glu70, His143 and Asp146 in *T. thermophilus* RuvC), and cleave Holliday junctions through a two-metal mechanism (Ariyoshi et al., 1994; Chen et al., 2013; Gorecka et al., 2013). Asp10 (Ala), Glu762, His983 and Asp986 of the Cas9 RuvC domain are located at positions similar to those of the catalytic residues of *T. thermophilus* RuvC (FIG. 32A, B), consistent with the previous results that the D10A mutation abolished cleavage of the non-complementary DNA strand and that Cas9 requires Mg2+ ions for cleavage activity (Gasiunas et al., 2012; Jinek et al., 2012). Moreover, alanine substitution of Glu762, His983 or Asp986 also converted Cas9 into nickases (FIG. 32C, D). Each nickase mutant was able to facilitate targeted double strand breaks using pairs of juxtaposed sgRNAs (FIG. 32C, D), as demonstrated with the D10A nickase previously (Ran et al., 2013). This combination of structural observations and mutational analysis suggest that the Cas9 RuvC domain cleaves the non-complementary strand of the target DNA through the two-metal mechanism previously observed for other retroviral integrase superfamily nucleases.

It is important to note that there are key structural dissimilarities between the Cas9 RuvC domain and RuvC nucleases, explaining their functional differences. Unlike the Cas9 RuvC domain, RuvC nucleases forms a dimer and recognize a Holliday junction (Gorecka et al., 2013) (FIG. 32B). In addition to the conserved RNase H fold, the RuvC domain of Cas9 has additional structural elements involved in the interactions with the guide:DNA duplex (an end-capping loop between α43 and α44), and the PI domain/stem loop 3 (β-hairpin formed by β3 and β4) (FIG. 32A).

Figure 32E:
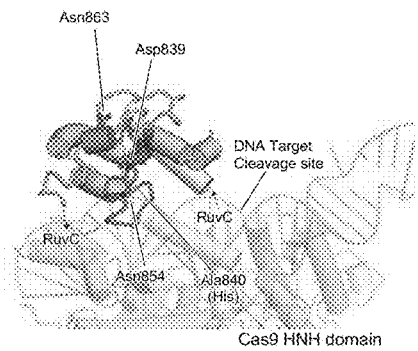
Figure 32F:
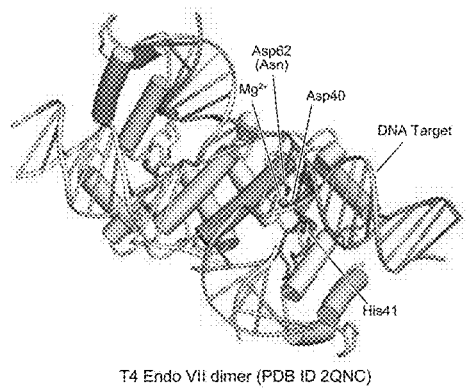
Figure 33A:
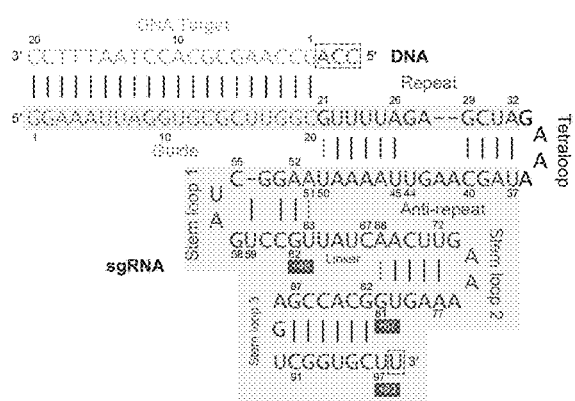
FIG. 33A-D shows sgRNA and its target DNA. (A) Schematic of the sgRNA:DNA complex. The guide and repeat regions of the crRNA sequence are colored skyblue and blue, respectively. The tracrRNA sequence is colored red, with the linker region colored violet. The target DNA and tetraloop are colored yellow and black, respectively. The numbering of the 3' tails of tracrRNA is shown on red background. Watson-Crick and non-Watson-Crick base pairs are indicated by black and gray lines, respectively. Disordered nucleotides are boxed by dashed lines. (B) Structure of the sgRNA:DNA complex. (C) Structure of the repeat:anti-repeat duplex and three-way junction. Key interactions are shown as gray dashed lines. (D) Effect of sgRNA mutations on ability to induce indels. Base changes from the +83 sgRNA scaffold are shown at respective positions, with dashes indicating unaltered bases (n=3, error bars show mean±S.E.M., p values based on unpaired Student's t-test, N.D., not detectable). See also FIG. 42.

The HNH domain targets the complementary strand DNA: The HNH domain comprises a two-stranded antiparallel β-sheet (β12 and β13) flanked by four α-helices (α36-α42) (FIG. 32E). Likewise, it shares structural similarity with HNH endonucleases characterized by a ββα-metal fold, such as the phage T4 endonuclease VII (Endo VII) (Biertumpfel et al., 2007) (PDB code 2QNC, 8% identity, rmsd of 2.6 Å for 60 equivalent Cα atoms) (FIG. 32F) and *Vibrio vulnificus* nuclease (Li et al., 2003) (PDB code 1OUP, 8% identity, rmsd of 2.9 Å for 78 equivalent Cα atoms). HNH nucleases have three catalytic residues (e.g., Asp40, His41, and Asn62 in Endo VII), and cleave nucleic acid substrates through a single-metal mechanism (Biertumpfel et al., 2007; Li et al., 2003). In the structure of the Endo VII N62D mutant in complex with a Holliday junction, a Mg2+ ion is coordinated by Asp40, Asp62, and oxygen atoms of the scissile phosphate group of the substrate, while His41 acts as a general base to activate a water molecule for catalysis (FIG. 32F). Asp839, His840, and Asn863 of the Cas9 HNH domain correspond to Asp40, His41, and Asn62 of Endo VII, respectively (FIG. 32E), consistent with the observation that His840 is critical for the cleavage of the complementary DNA strand (Gasiunas et al., 2012; Jinek et al., 2012). The N863A mutant functions as a nickase (FIG. 32C, D), indicating that Asn863 participates in catalysis. These observations suggest that the Cas9 HNH domain may cleave the complementary strand of the target DNA through a single-metal mechanism as observed for other HNH superfamily nucleases. However, in the present structure, Asn863 of Cas9 is located at a position different from that of Asn62 in Endo VII (Biertumpfel et al., 2007), whereas Asp839 and His840 (Ala) of Cas9 are located at positions similar to those of Asp40 and His41 of Endo VII, respectively (FIG. 32E, F). This might be due to the absence of divalent ions, such as Mg2+, in Applicants' crystallization solution, suggesting that Asn863 can point towards the active site and participate in catalysis. Whereas the HNH domain shares a ββα-metal fold with other HNN endonuclease, their overall structures are different (FIG. 32E, F), consistent with the differences in their substrate specificities.

sgRNA recognizes target DNA via Watson-Crick base pairing: The sgRNA consists of crRNA- and tracrRNA-derived sequences connected by an artificial tetraloop (FIG. 33A). The crRNA sequence can be subdivided into guide (20-nt) and repeat (12-nt) regions, and the tracrRNA sequence likewise into anti-repeat (14-nt) and three tracrRNA stem loops (FIG. 33A). The crystal structure reveals that the sgRNA binds the target DNA to form a T-shaped architecture comprising a guide:DNA duplex, repeat:anti-repeat duplex and stem loops 1-3 (FIG. 33A, B). The repeat:anti-repeat duplex and stem loop 1 are connected by a single nucleotide (A51), and stem loops 1 and 2 are connected by a 5-nt single-stranded linker (nucleotides 63-67).

Figure 33B:
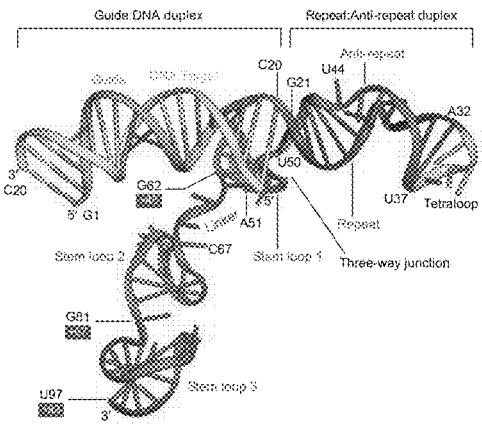
Figure 33C:
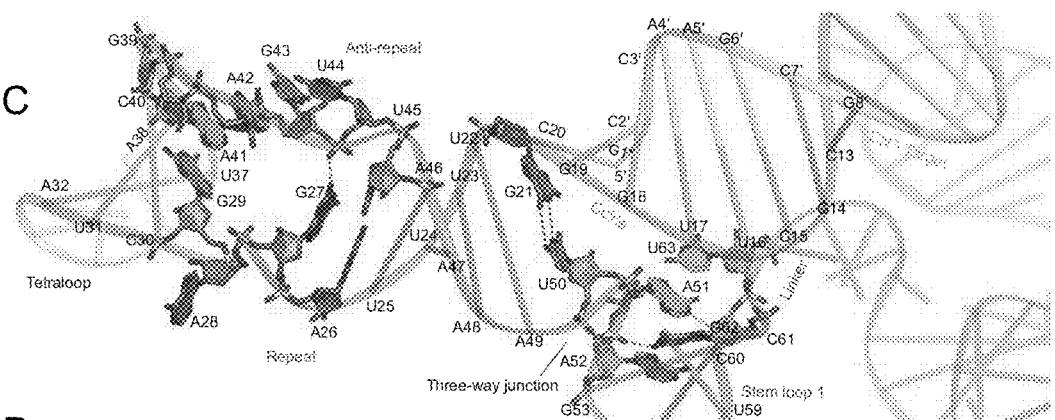
Figure 42:
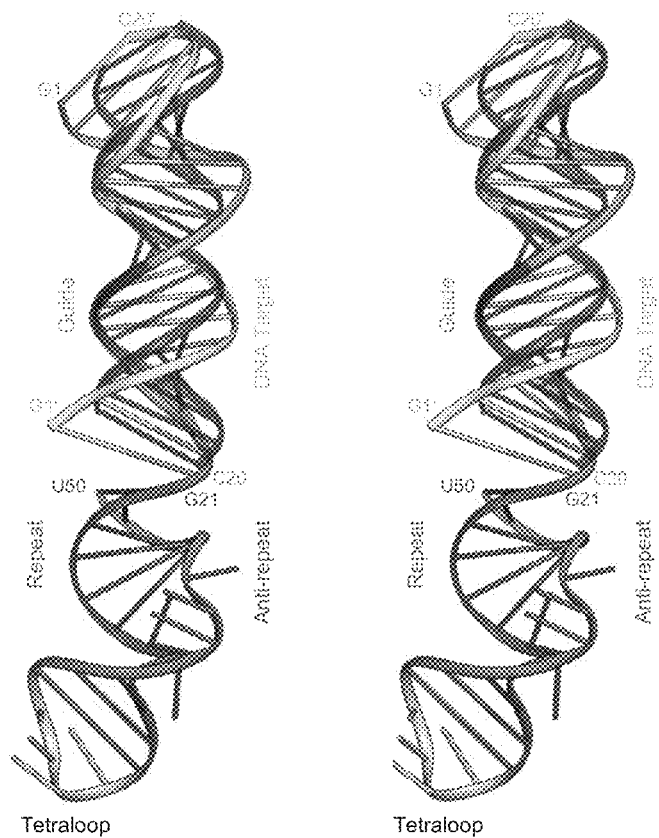
FIG. 42 shows the comparison of the sgRNA:DNA heteroduplex with a canonical A-form RNA duplex. The sgRNA:DNA heteroduplex are superimposed on an A-form RNA duplex based on their phosphorus atoms. The A-form RNA duplex is colored dark gray. Nucleotides 51-97 of the sgRNA are omitted for clarity.

The guide (nucleotides 1-20) and target DNA (nucleotides 3'-23') form the guide:DNA hybrid duplex via 20 Watson-Crick base pairs, with the conformation of the duplex distorted from a canonical A-form RNA duplex (FIGS. 33B and 42). The crRNA repeat (nucleotides 21-32) and tracrRNA anti-repeat (nucleotides 37-50) form the repeat:anti-repeat duplex via nine Watson-Crick base pairs (U22:A49-A26:U45 and G29:C40-A32:U37) (FIG. 33A, B). Within this region, G27, A28, A41, A42, G43, and U44 are unpaired, with A28 and U44 flipped out from the duplex (FIG. 33C). The nucleobases of G27 and A41 stack with the A26:U45 and G29:C40 pairs, respectively, and the 2-amino group of G27 interacts with the backbone phosphate group between G43 and U44, stabilizing the duplex structure (FIG. 33C). G21 and U50 form a wobble base pair at the three-way junction between the guide:DNA/repeat:anti-repeat duplexes and stem loop 1, stabilizing the T-shaped architecture (FIG. 33C).

As expected from the RNA-fold predictions of the nucleotide sequence, the tracrRNA 3' tail (nucleotides 68-81 and 82-96) form stem loops 2 and 3 via four and six Watson-Crick base pairs (A69:U80-U72:A77 and G82:C96-G87:C91), respectively (FIG. 33A, B). Previously unappreciated, nucleotides 52-62 also form a stem loop (stem loop 1) via three Watson-Crick base pairs (G53:C61, G54:C60 and C55:G58), with U59 flipped out from the stem (FIG. 33A, B). Stem loop 1 is stabilized by the G62-G53:C61 stacking interaction and the G62-A51/A52 polar interactions (FIG. 33C).

The guide:DNA and repeat:anti-repeat duplexes are accommodated and deeply buried in a positively-charged groove at the interface of the two lobes, while the rest of the sgRNA extensively interacts with the positively-charged surface on the back side of the protein (FIG. 30D). In Mol A, the 3'-terminal bases of the target DNA (3'-ACC complementary to the PAM) are not visible in the electron density map. In contrast, the two adjacent bases (3'-AC) in Mol B are not recognized by Cas9, although they are structurally ordered due to the crystal packing interactions and are visible in the electron density map. These observations suggest that the 3'-ACC sequence complementary to the PAM (5'-TGG) is not recognized by Cas9, consistent with the previous biochemical data demonstrating that Cas9-catalyzed DNA cleavage requires the 5'-NGG PAM on the non-complementary strand, but not the 3'-NCC sequence on the complementary strand (Jinek et al., 2012).

Previous studies showed that although sgRNA with a 48-nt tracrRNA tail (referred to as sgRNA(+48)) is a minimal region for the Cas9-catalyzed DNA cleavage in vitro (Jinek et al., 2012), sgRNAs with extended tracrRNA tails, sgRNA(+67) and sgRNA(+85), dramatically improved Cas9 cleavage activity in vivo (Hsu et al., 2013). The present structure revealed that sgRNA(+48), sgRNA(+67) and sgRNA(+85) contain stem loop 1, stem loops 1-2 and stem loops 1-3, respectively (FIG. 33A, B). These observations indicated that, whereas stem loop 1 is essential for the formation of the functional Cas9-sgRNA complex, stem loops 2 and 3 further support the stable complex formation as well as enhance sgRNA stability, thus improving the in vivo activity.

Figure 33D:
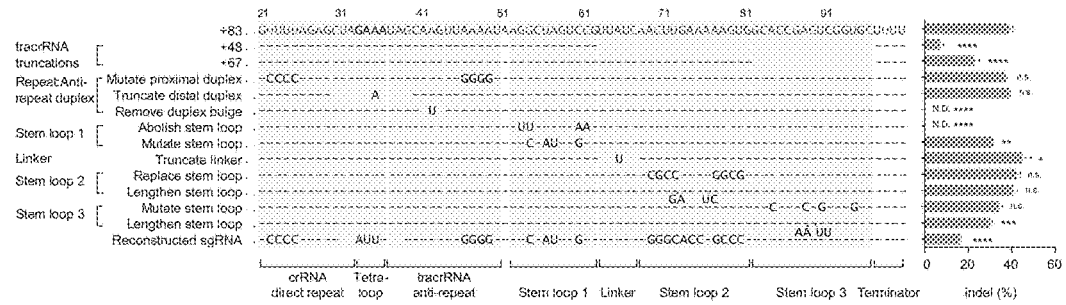

To confirm the significance of each sgRNA structural component on Cas9 function, Applicants tested a number of sgRNAs with mutations in the repeat:anti-repeat duplex, stem loops 1-3, and the linker between stem loops 1 and 2. Applicants' results revealed that, whereas stem loops 2 and 3 as well as the linker region can tolerate a large number of mutations, the repeat:anti-repeat duplex and stem loop 1 are critical for Cas9 function (FIG. 33D). Moreover, the sgRNA sequence can tolerate a large number of mutations (FIG. 33D, reconstructed sgRNA). These results highlight the functional significance of the structure-dependent recognition of the repeat:anti-repeat duplex by Cas9.

Figure 34A:
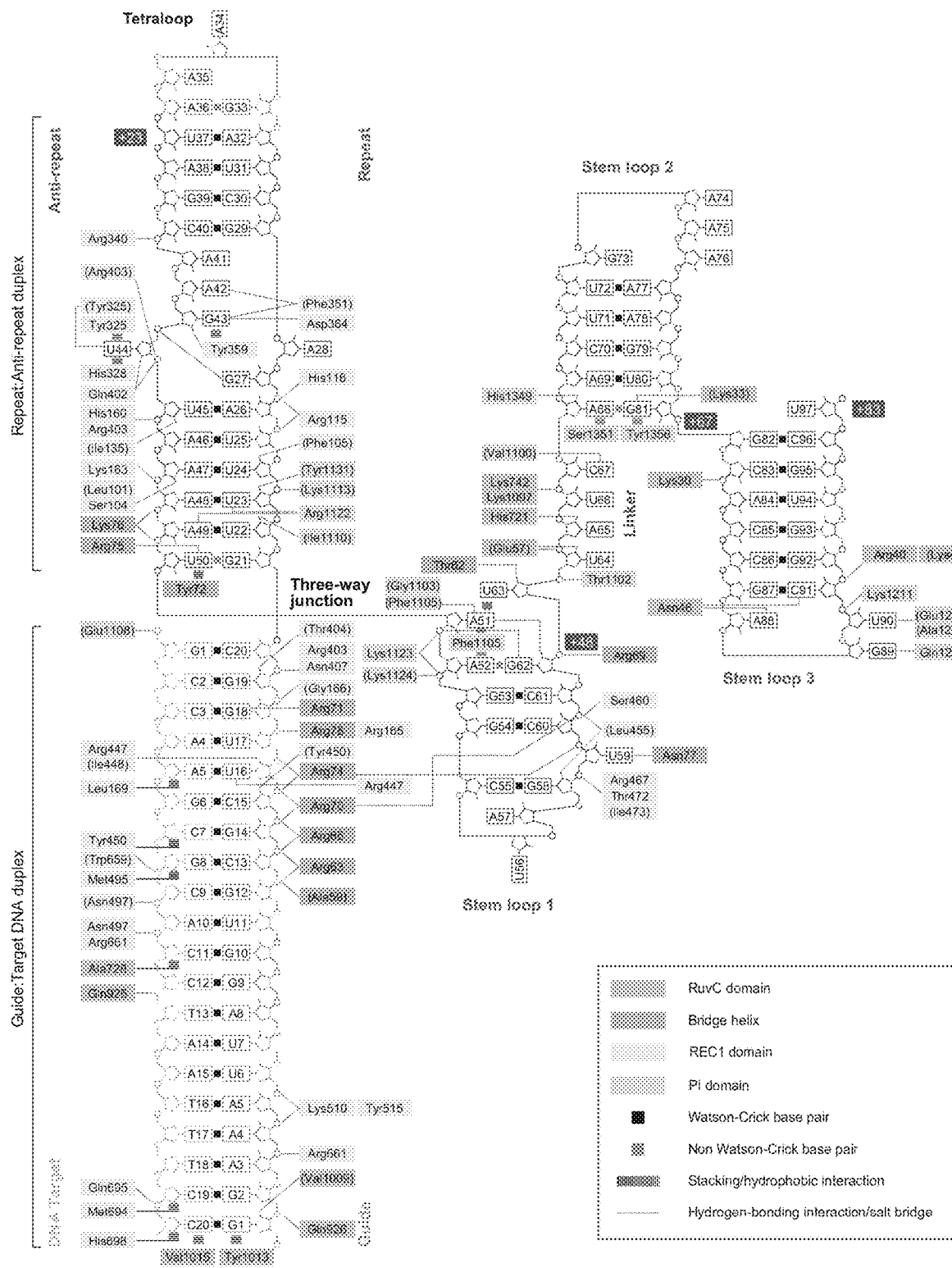

Conserved arginine cluster on Bridge helix play a critical role in sgRNA:DNA interaction: The crRNA guide region is primarily recognized by the REC lobe (FIG. 34A). The backbone phosphate groups of the crRNA guide region (nucleotides 4-6 and 13-20) interact with the REC1 domain (Arg165, Gly166, Arg403, Asn407, Lys510, Tyr515 and Arg661) and Bridge helix (Ala59, Arg63, Arg66, Arg70, Arg71, Arg74 and Arg78) (FIG. 34B), and the 2'-hydroxyl groups of C15, U16 and G19 hydrogen bond with Tyr450, Arg447/Ile448 and Thr404 in the REC1 domain (FIG. 34B), respectively. These observations suggested that the Watson-Crick faces of eight PAM-proximal nucleotides of the Cas9-bound sgRNA are exposed to the solvent, thus serving as a nucleation site for pairing with the target complementary strand. This is consistent with previous reports that the 10-12 bp PAM-proximal "seed" region is critical for Cas9-catalyzed DNA cleavage (Cong et al., 2013; Fu et al., 2013; Hsu et al., 2013; Jinek et al., 2012; Mali et al., 2013a; Pattanayak et al., 2013).

Mutational analysis demonstrated that the R66A, R70A and R74A mutations on Bridge helix markedly reduced DNA cleavage activities (FIG. 34C), highlighting the functional significance of the recognition of the sgRNA "seed" region by the Bridge helix. Although Arg78 and Arg165 also interact with the "seed" region, the R78A and R165A mutants showed only moderately decreased activities (FIG. 34C). These results may reflect that, whereas Arg66, Arg70 and Arg74 form bifurcated salt bridges with the sgRNA backbone, Arg78 and Arg165 form a single salt bridge with the sgRNA backbone. A cluster of arginine residues on the Bridge helix are highly conserved among Cas9 proteins in the Type II-A-C systems (FIGS. 40, 41), suggesting that the Bridge helix is a universal structural feature of Cas9 proteins involved in recognition of the sgRNA and target DNA. This notion is supported by a previous observation that a strictly conserved arginine residue, equivalent to Arg70 of *S. pyogenes* Cas9, is essential for the function of *Francisella novicida* Cas9 in the Type II-B system (Sampson et al., 2013). Moreover, the alanine mutation of the repeat:anti-repeat duplex-interacting residues (Arg75 and Lys163) and stem loop 1-interacting residue (Arg69) resulted in decreased DNA cleavage activity (FIG. 34C), confirming the functional importance of the recognition of the repeat:anti-repeat duplex and stem loop 1 by Cas9.

The crRNA guide region is recognized by Cas9 in a sequence-independent manner except for the U16-Arg447 and G18-Arg71 interactions (FIG. 34A, B). This base-specific G18-Arg71 interaction may partly explain the observed preference of Cas9 for sgRNAs having guanines in the four PAM-proximal guide sequences (Wang et al., 2014).

The REC1 and RuvC domains facilitate RNA-guided DNA targeting: Cas9 recognizes the 20-bp DNA target site in a sequence-independent manner (FIG. 34A). The backbone phosphate groups of the target DNA (nucleotides 1', 9'-11', 13', and 20') interact with the REC1 (Asn497, Trp659, Arg661 and Gln695), RuvC (Gln926), and PI (Glu1108) domains. The C2' atoms of the target DNA (nucleotides 5', 7', 8', 11', 19', and 20') form van der Waals interactions with the REC1 domain (Leu169, Tyr450, Met495, Met694 and His698) and RuvC domain (Ala728) (FIG. 34D). These interactions are likely to contribute towards discriminating between DNA vs. RNA targets by Cas9. The terminal base pair of the guide:DNA duplex (G1:C20') is recognized by the RuvC domain via end-capping interactions (FIG. 34D); the nucleobases of sgRNA G1 and target DNA C20' interact with the side chains of Tyr1013 and Val1015, respectively, whereas the 2'-hydroxyl and phosphate groups of sgRNA G1 interact with Val1009 and Gln926, respectively. These end-capping interactions are consistent with the previous observation that Cas9 recognizes a 17-20-bp guide:DNA duplex, and that extended guide sequences are degraded in cells and do not contribute to improving sequence specificity (Mali et al., 2013a; Ran et al., 2013). Taken together, these structural findings explain the RNA-guided DNA targeting mechanism of Cas9.

The repeat:anti-repeat duplex is recognized by the REC and NUC lobes in a sequence-dependent manner: The repeat:anti-repeat duplex is extensively recognized by the REC and NUC lobes (FIG. 34A). The backbone phosphate groups of the crRNA repeat (nucleotides 24, 26, and 27) and anti-repeat (nucleotides 41, 45, 46, and 48-50) interact with the REC1 domain (Arg115, His116, His160, Lys163, Arg340, and Arg403), PI domain (Lys1113), and Bridge helix (Lys76) (FIG. 34E, F). The 2'-hydroxyl groups of the crRNA repeat (nucleotides 22-24) and anti-repeat (nucleotides 43-45 and 47) hydrogen bond with the REC1 domain (Leu101, Ser104, Phe105, Ile135, Tyr359, and Gln402) and the PI domain (Ile1110 and Tyr1131).

In contrast to the sequence-independent recognition of the guide region, there are sequence-dependent interactions between Cas9 and the repeat:anti-repeat duplex. The nucleobase of the flipped U44 is sandwiched between the side chains of Tyr325 and His328, with its N3 atom hydrogen bonded with the carbonyl group of Tyr325, while that of unpaired G43 stacks with the side chain of Tyr359 and hydrogen bonds with the side chain of Asp364 (FIG. 34A, F). Finally, the nucleobases of U23/A49 and A42/G43 hydrogen bond with the side chain of Arg1122 and the main-chain carbonyl group of Phe351, respectively.

In the present structure, the repeat:anti-repeat duplex is recognized primarily by the REC lobe, which is divergent in sequence and length among Cas9 orthologs within the Type II-A-C systems (FIGS. 40, 41), consistent with the previous observation that Cas9 and sgRNA are interchangeable only between closely related Type II systems (Fonfara et al., 2013). The three PAM-distal base pairs (C30:G39-A32:U37) are not recognized by Cas9 and protrude from the complex (FIG. 34A), consistent with a proposed model in which a Cas9-bound repeat:anti-repeat duplex is processed by the host RNase III enzyme (Deltcheva et al., 2011).

The nucleobases of G21 and U50 in the G21:U50 wobble pair stack with the terminal C20:G1' pair in the guide:DNA duplex and the side chain of Tyr72 on Bridge helix, respectively, with the U50 O4 atom hydrogen bonded with the side chain of Arg75 (FIG. 34E). Notably, A51 adopts the syn-conformation, and is oriented in the direction opposite to U50 (FIGS. 33C and 34G). The nucleobase of A51 is sandwiched between the Phe1105 side chain in the PI domain and the U63 nucleobase in the linker, with its N7 and N1 atoms hydrogen bonded with the main-chain amide group of Phe1105 and the G62 2'-hydroxyl group in stem loop 1, respectively (FIG. 34G). Whereas a repeat:anti-repeat duplex is diverse in sequence and length among the Type II-A-C systems, the G21:U50 base pair is highly conserved among Cas9s (Fonfara et al., 2013), suggesting that this wobble pairing is a universal structural feature involved in the three-way junction formation.

To verify the sequence-dependent recognition of the repeat:anti-repeat duplex, Applicants evaluated the effect of repeat:anti-repeat mutations on Cas9-meditated DNA cleavage, and found multiple mutations that significantly reduce Cas9 activity (FIG. 34C). Notably, replacement of G43, which forms a base-specific hydrogen bond with Asp364, with adenine reduced Cas9 activity by over 3-fold. In addition, replacement of the flipped U44 in the repeat:anti-repeat duplex with adenine resulted in over a 5-fold drop in cleavage activity, whereas replacement of U44 with another pyrimidine base (cytosine) did not significantly affect cleavage activity (FIG. 34C). These results suggest that base-specific recognition of G43 and U44 could play an important role in sgRNA recognition by Cas9.

sgRNA stem loops 1-3 interact with Cas9: Stem loop 1 is primarily recognized by the REC lobe together with the PI domain (FIG. 34A). The backbone phosphate groups of stem loop 1 (nucleotides 52, 53, and 59-61) interact with the REC1 domain (Leu455, Ser460, Arg467, Thr472, and Ile473), PI domain (Lys1123 and Lys1124), and Bridge helix (Arg70 and Arg74), with the 2'-hydroxyl group of G58 hydrogen bonded with Leu455 in the REC1 domain. A52 interacts with Phe1105 through a face-to-edge π-π stacking interaction (FIG. 34G), and the flipped U59 nucleobase hydrogen bonds with the side chain of Asn77 (FIG. 34H).

Stem loops 2 and 3, and the single-stranded linker are primarily recognized by the NUC lobe (FIG. 34A); this contrasts with stem loop 1 and the guide:DNA/repeat:anti-repeat duplexes, which are recognized by both of the NUC and REC lobes. The backbone phosphate groups of the linker (nucleotides 63-65 and 67) interact with the RuvC domain (Glu57, Lys742, and Lys1097), PI domain (Thr1102), and Bridge helix (Arg69), with the 2'-hydroxyl groups of U64 and A65 hydrogen bonded with Glu57 and His721, respectively (FIG. 34I). The nucleobase of C67 hydrogen bonds with the main-chain amide group of Val1100 (FIG. 34I).

Stem loop 2 is recognized by Cas9 via the interactions between the NUC lobe and the non-Watson-Crick A68:G81 pair, which is formed by direct (between the A68 N6 and G81 O6 atoms) and water-mediated (between the A68 N1 and G81 N1 atoms) hydrogen-bonding interactions (FIG. 34J). The nucleobases of A68 and G81 contact the side chains of Ser1351 and Tyr1356, respectively, with the A68: G81 pair recognized by Thr1358 via a water-mediated hydrogen bond (FIG. 34J). The 2'-hydroxyl group of A68 hydrogen bonds with the side chain of His1349, and the 2-amino group of G81 hydrogen bonds with the main-chain carbonyl group of Lys33 (FIG. 34J).

Stem loop 3 interacts with the NUC lobe more extensively relative to stem loop 2 (FIG. 34K). The backbone phosphate groups of C91 and G92 interact with the RuvC domain (Arg40 and Lys44) (FIG. 34K), while the nucleobases of G89 and U90 hydrogen bond with Gln1272 and Glu1225/ Ala1227, respectively (FIG. 34K). The nucleobases of A88 and C91 are recognized by the side chain of Asn46 via multiple hydrogen-bonding interactions (FIG. 34K).

Structural flexibility of Cas9 and sgRNA: Although the HNH domain cleaves the complementary strand of the target DNA at a position three nucleotides upstream of the PAM sequence (Gasiunas et al., 2012; Jinek et al., 2012), in the present structure the HNH domain is positioned away from the scissile phosphate group of the bound complementary strand (FIG. 35A). A structural comparison of Mol A and Mol B provided mechanistic insights into the complementary strand cleavage by the HNH domain. In Mol A, the HNH domain is followed by the α40 helix of the RuvC domain, which is connected with the α41 helix by an α40-α41 linker (residues 919-925) (FIG. 35A). Whereas in Mol A residues 913-925 form the C-terminal portion of the α43 helix and α43-α44 linker, in Mol B these residues form an extended α-helix, which is directed toward the cleavage site of the complementary strand (FIG. 35A). These observations suggest that the HNH domain can approach and cleave the target DNA through conformational changes in the segment connecting the HNH and RuvC domains.

Moreover, the structural comparison revealed a conformational flexibility between the REC and NUC lobes (FIG. 35B). Compared to Mol A, Mol B adopts a more open conformation, in which the two lobes are rotated by 15° at a hinge loop between Bridge helix and the strand β5 in the RuvC domain (FIG. 35B). The bound sgRNA also undergoes an accompanying conformational change at the single-stranded linker, which interacts with the hinge loop (FIG. 35C). Applicants also observed an accompanying displacement of the O17-O18 loop of the PI domain, which interacts with the repeat:anti-repeat duplex and the α2-α3 loop of the REC1 domain (FIG. 35B). Notably, there is no direct contact between the two lobes in the present structure, except for the interactions between the α2-α3 and β17-β18 loops (FIG. 35D), suggesting that Cas9 is highly flexible in the absence of the sgRNA. The flexible nature of Cas9 is likely to play a role in the assembly of the Cas9-sgRNA-DNA ternary complex.

The crystal structure of Cas9 in complex with guide RNA and target DNA reveals that the 20-bp heteroduplex formed by the crRNA guide region and the complementary strand of the target DNA is accommodated in the positively-charged groove at the interface between the REC and NUC lobes of Cas9, with the scissile phosphate group of the target properly positioned for cleavage by the HNH domain. Although the present structure does not contain the non-complementary DNA strand, the position of the bound complementary strand suggests that the scissile phosphate of the non-complementary strand is located in the vicinity of the active site of the RuvC domain, consistent with previous biochemical data (Gasiunas et al., 2012; Jinek et al., 2012). Furthermore, Applicants' structural and functional analyses indicate that the PI domain participates in the recognition of the PAM sequence of the non-complementary strand.

Figure 36:
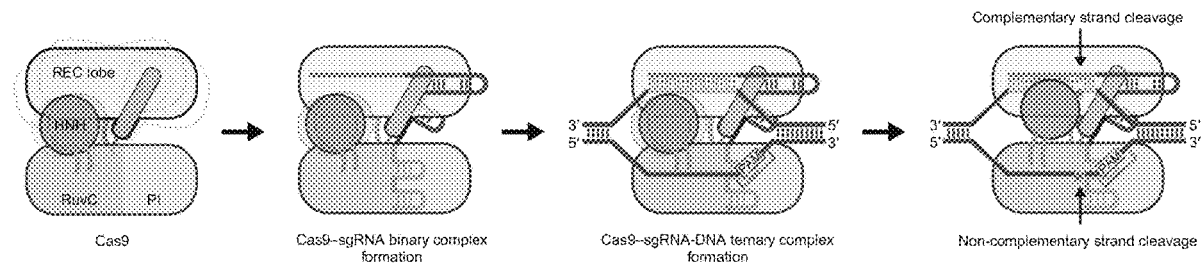
FIG. 36 shows a Model of RNA-guided DNA cleavage by Cas9.

Based on these observations, Applicants propose a model for the Cas9-catalyzed RNA-guided DNA cleavage (FIG. 36). Cas9 recognizes the PAM-proximal guide region and repeat:anti-repeat duplex of sgRNA to form a Cas9-sgRNA binary complex. The binary complex subsequently recognizes the DNA sequence complementary to the 20-nt guide region of the bound sgRNA, forming the final Cas9-sgRNA-target DNA ternary complex. During the ternary complex formation, the PI domain recognizes the PAM sequence of the non-complementary strand, facilitating the R-loop formation. Upon assembly of the ternary complex, the mobile HNH domain approaches and cleaves the complementary strand in the guide:DNA duplex, whereas the RuvC domain cleaves the single-stranded, non-complementary strand.

Applicants' crystal structure provides a critical step towards understanding the molecular mechanism of RNA-guided DNA targeting by Cas9. Further structural and functional studies with *S. pyogenes* Cas9 or related orthologs, including the structural determination of the Cas9-sgRNA-DNA ternary complex containing the non-complementary strand, may be important for illuminating details such as Cas9-mediated recognition of PAM sequences on the target DNA or mismatch tolerance between the sgRNA:DNA duplex. However, the present structural and functional analyses already provide a useful scaffold for rational engineering of Cas9-based genome modulating technologies. Applicants reported, for example, an *S. pyogenes* Cas9 truncation mutant (FIG. 31B) that will facilitate packaging of Cas9 into size-constrained viral vectors for in vivo and therapeutic applications. Similarly, future engineering of the PI domain allows for programming of PAM specificity, improving target site recognition fidelity, and increasing the versatility of the Cas9 genome engineering platform.

EXPERIMENTAL PROCEDURES

Protein preparation: The gene encoding full-length *S. pyogenes* Cas9 (residues 1-1368) was cloned between the NdeI and XhoI sites of the modified pCold-GST vector (TaKaRa). The protein was expressed at 20° C. in *Escherichia coli* Rosetta 2 (DE3) (Novagen), and was purified by Ni-NTA Superflow resin (QIAGEN). The eluted protein was incubated overnight at 4° C. with TEV protease to remove the GST-tag, and further purified by chromatography on Ni-NTA, Mono S (GE Healthcare) and HiLoad Superdex 200 16/60 (GE Healthcare) columns. The SeMet-labeled protein was prepared using a similar protocol for the native protein. The sgRNA was in vitro transcribed by T7 polymerase using a PCR-amplified template, and was purified on 10% denaturing polyacrylamide gel electrophoresis. The target DNA was purchased from Sigma-Aldrich. The purified Cas9 protein was mixed with sgRNA and DNA (molar ratio 1:1.5:2), and then the complex was purified using a Superdex 200 Increase column (GE Healthcare) in a buffer containing 10 mM Tris-HCl, pH 8.0, 150 mM NaCl and 1 mM DTT.

Crystallography: The purified Cas9-sgRNA-DNA complex was crystallized at 20° C. by the hanging-drop vapor diffusion method. Crystals were obtained by mixing 1 μl of complex solution ($A_{260\,nm}$=15) and 1 μl of reservoir solution (12% PEG 3,350, 100 mM Tris-HCl, pH 8.0, 200 mM ammonium acetate, 150 mM NaCl and 100 mM NDSB-256).The SeMet-labeled protein was crystallized under conditions similar to those for the native protein. X-ray diffraction data were collected at 100 K on the beamlines BL32XU and BL41XU at SPring-8 (Hyogo, Japan). The crystals were cryoprotected in reservoir solution supplemented with 25% ethylene glycol. X-ray diffraction data were processed using XDS (Kabsch, 2010). The structure was determined by the SAD method, using the 2.8 Å resolution data from the SeMet-labeled crystal. Forty of the potential 44 Se atoms were located using SHELXD (Sheldrick, 2008) and autoSHARP (delaFortelle and Bricogne, 1997). The initial phases were calculated using autoSHARP, and further improved by 2-fold NCS averaging using DM (Winn et al., 2011). The model was automatically built using PHENIX AutoSol (Adams et al., 2002), followed by manual model building using COOT (Emsley and Cowtan, 2004) and refinement using PHENIX (Adams et al., 2002). The resulting model was further refined using for native 2.4 Å resolution data.

Cell culture and transfection: Human embryonic kidney (HEK) cell line 293FT (Life Technologies) or mouse Neuro 2a (Sigma-Aldrich) cell line was maintained in Dulbecco's modified Eagle's Medium (DMEM) supplemented with 10% fetal bovine serum (HyClone), 2 mM GlutaMAX (Life Technologies), 100 U/ml penicillin, and 100 μg/ml streptomycin at 37° C. with 5% $CO_2$ incubation. Cells were seeded onto 24-well plates (Corning) at a density of 120,000 cells/well, 24 h prior to transfection. Cells were transfected using Lipofectamine 2000 (Life Technologies) at 70-80% confluency following the manufacturer's recommended protocol. A total of 400 ng Cas9 plasmid and 100 ng of U6::sgRNA PCR product was transfected.

SURVEYOR nuclease assay for genome modification: 293FT cells were transfected with DNA as described above. Cells were incubated at 37° C. for 72 h post-transfection prior to genomic DNA extraction. Genomic DNA was extracted using the QuickExtract DNA Extraction Solution (Epicentre) following the manufacturer's protocol. Briefly, pelleted cells were resuspended in QuickExtract solution and incubated at 65° C. for 15 min, 68° C. for 15 min, and 98° C. for 10 min.

The genomic region flanking the CRISPR target site for each gene was PCR amplified, and products were purified using QiaQuick Spin Column (Qiagen) following the manufacturer's protocol. 400 ng total of the purified PCR products were mixed with 2 μl 10×Taq DNA Polymerase PCR buffer (Enzymatics) and ultrapure water to a final volume of 20 μl, and subjected to a re-annealing process to enable heteroduplex formation: 95° C. for 10 min, 95° C. to 85° C. ramping at −2° C./s, 85° C. to 25° C. at −0.25° C./s, and 25° C. hold for 1 min. After re-annealing, products were treated with SURVEYOR nuclease and SURVEYOR enhancer S (Transgenomics) following the manufacturer's recommended protocol, and analyzed on 4-20% Novex TBE poly-acrylamide gels (Life Technologies). Gels were stained with SYBR Gold DNA stain (Life Technologies) for 30 min and imaged with a Gel Doc gel imaging system (Bio-rad). Quantification was based on relative band intensities. Indel percentage was determined by the formula, $100 \times (1-(1-(b+c)/(a+b+c))^{1/2})$, where a is the integrated intensity of the undigested PCR product, and b and c are the integrated intensities of each cleavage product.

Western blot: HEK 293FT cells were transfected and lysed in 1×RIPA buffer (Sigma-Aldrich) supplemented with Protease Inhibitor (Roche). Lysates were loaded onto Bolt 4-12% Bis-Tris Plus Gel (Invitrogen) and transferred to nitrocellulose membranes. Membranes were blocked in Tris-buffered saline containing 0.1% Tween-20 and 5% blocking agent (G-Biosciences). Membrane was probed with rabbit anti-FLAG (1:5000, Abcam), HRP-conjugated anti-GAPDH (1:5,000 Cell Signaling Technology), and HRP-conjugated anti-rabbit (1:1000). Blots were visualized on Gel Doc XR+ System (Bio-rad).

Sequence Information:

```
Italic: 3XFLAG sequence
Underlined: NLS sequences

Wildtype SpCas9
ATGGACTATAAGGACCACGACGGAGACTACAAGGATCATGATATTGATTACAAAGACGATGACGATAAGATGG

CCCCAAAGAAGAAGCGGAAGGTCGGTATCCACGGAGTCCCAGCAGCCGACAAGAAGTACAGCATCGG

CCTGGACATCGGCACCAACTCTGTGGGCTGGGCCGTGATCACCGACGAGTACAAGGTGCCCAGCAAG

AAATTCAAGGTGCTGGGCAACACCGACCGGCACAGCATCAAGAAGAACCTGATCGGAGCCCTGCTGT

TCGACAGCGGCGAAACAGCCGAGGCCACCCGGCTGAAGAGAACCGCCAGAAGAAGATACACCAGAC

GGAAGAACCGGATCTGCTATCTGCAAGAGATCTTCAGCAACGAGATGGCCAAGGTGGACGACAGCTT

CTTCCACAGACTGGAAGAGTCCTTCCTGGTGGAAGAGGATAAGAAGCACGAGCGGCACCCCATCTTCG

GCAACATCGTGGACGAGGTGGCCTACCACGAGAAGTACCCCACCATCTACCACCTGAGAAAGAAACT

GGTGGACAGCACCGACAAGGCCGACCTGCGGCTGATCTATCTGGCCCTGGCCCACATGATCAAGTTCC

GGGGCCACTTCCTGATCGAGGGCGACCTGAACCCCGACAACAGCGACGTGGACAAGCTGTTCATCCAG

CTGGTGCAGACCTACAACCAGCTGTTCGAGGAAAACCCCATCAACGCCAGCGGCGTGGACGCCAAGG

CCATCCTGTCTGCCAGACTGAGCAAGAGCAGACGGCTGGAAAATCTGATCGCCCAGCTGCCCGGCGAG

AAGAAGAATGGCCTGTTCGGCAACCTGATTGCCCTGAGCCTGGGCCTGACCCCCAACTTCAAGAGCAA

CTTCGACCTGGCCGAGGATGCCAAACTGCAGCTGAGCAAGGACACCTACGACGACGACCTGGACAAC

CTGCTGGCCCAGATCGGCGACCAGTACGCCGACCTGTTTCTGGCCGCCAAGAACCTGTCCGACGCCAT

CCTGCTGAGCGACATCCTGAGAGTGAACACCGAGATCACCAAGGCCCCCCTGAGCGCCTCTATGATCA

AGAGATACGACGAGCACCACCAGGACCTGACCCTGCTGAAAGCTCTCGTGCGGCAGCAGCTGCCTGA

GAAGTACAAAGAGATTTTCTTCGACCAGAGCAAGAACGGCTACGCCGGCTACATTGACGGCGGAGCC

AGCCAGGAAGAGTTCTACAAGTTCATCAAGCCCATCCTGGAAAAGATGGACGGCACCGAGGAACTGC

TCGTGAAGCTGAACAGAGAGGACCTGCTGCGGAAGCAGCGGACCTTCGACAACGGCAGCATCCCCCA

CCAGATCCACCTGGGAGAGCTGCACGCCATTCTGCGGCGGCAGGAAGATTTTTACCCATTCCTGAAGG

ACAACCGGGAAAAGATCGAGAAGATCCTGACCTTCCGCATCCCCTACTACGTGGGCCCTCTGGCCAGG

GGAAACAGCAGATTCGCCTGGATGACCAGAAAGAGCGAGGAAACCATCACCCCCTGGAACTTCGAGG

AAGTGGTGGACAAGGGCGCTTCCGCCCAGAGCTTCATCGAGCGGATGACCAACTTCGATAAGAACCTG

CCCAACGAGAAGGTGCTGCCCAAGCACAGCCTGCTGTACGAGTACTTCACCGTGTATAACGAGCTGAC

CAAAGTGAAATACGTGACCGAGGGAATGAGAAAGCCCGCCTTCCTGAGCGGCGAGCAGAAAAAGGCC

ATCGTGGACCTGCTGTTCAAGACCAACCGGAAAGTGACCGTGAAGCAGCTGAAAGAGGACTACTTCA

AGAAAATCGAGTGCTTCGACTCCGTGGAAATCTCCGGCGTGGAAGATCGGTTCAACGCCTCCCTGGGC

ACATACCACGATCTGCTGAAAATTATCAAGGACAAGGACTTCCTGGACAATGAGGAAAACGAGGACA

TTCTGGAAGATATCGTGCTGACCCTGACACTGTTTGAGGACAGAGAGATGATCGAGGAACGGCTGAAA

ACCTATGCCCACCTGTTCGACGACAAAGTGATGAAGCAGCTGAAGCGGCGGAGATACACCGGCTGGG

GCAGGCTGAGCCGGAAGCTGATCAACGGCATCCGGGACAAGCAGTCCGGCAAGACAATCCTGGATTT

CCTGAAGTCCGACGGCTTCGCCAACAGAAACTTCATGCAGCTGATCCACGACGACAGCCTGACCTTTA
```

```
AAGAGGACATCCAGAAAGCCCAGGTGTCCGGCCAGGGCGATAGCCTGCACGAGCACATTGCCAATCT
GGCCGGCAGCCCCGCCATTAAGAAGGGCATCCTGCAGACAGTGAAGGTGGTGGACGAGCTCGTGAAA
GTGATGGGCCGGCACAAGCCCGAGAACATCGTGATCGAAATGGCCAGAGAGAACCAGACCACCCAGA
AGGGACAGAAGAACAGCCGCGAGAGAATGAAGCGGATCGAAGAGGGCATCAAAGAGCTGGGCAGCC
AGATCCTGAAAGAACACCCCGTGGAAAACACCCAGCTGCAGAACGAGAAGCTGTACCTGTACTACCT
GCAGAATGGGCGGGATATGTACGTGGACCAGGAACTGGACATCAACCGGCTGTCCGACTACGATGTG
GACCATATCGTGCCTCAGAGCTTTCTGAAGGACGACTCCATCGACAACAAGGTGCTGACCAGAAGCGA
CAAGAACCGGGGCAAGAGCGACAACGTGCCCTCCGAAGAGGTCGTGAAGAAGATGAAGAACTACTGG
CGGCAGCTGCTGAACGCCAAGCTGATTACCCAGAGAAAGTTCGACAATCTGACCAAGGCCGAGAGAG
GCGGCCTGAGCGAACTGGATAAGGCCGGCTTCATCAAGAGACAGCTGGTGGAAACCCGGCAGATCAC
AAAGCACGTGGCACAGATCCTGGACTCCCGGATGAACACTAAGTACGACGAGAATGACAAGCTGATC
CGGGAAGTGAAAGTGATCACCCTGAAGTCCAAGCTGGTGTCCGATTTCCGGAAGGATTTCCAGTTTTA
CAAAGTGCGCGAGATCAACAACTACCACCACGCCCACGACGCCTACCTGAACGCCGTCGTGGGAACC
GCCCTGATCAAAAAGTACCCTAAGCTGGAAAGCGAGTTCGTGTACGGCGACTACAAGGTGTACGACGT
GCGGAAGATGATCGCCAAGAGCGAGCAGGAAATCGGCAAGGCTACCGCCAAGTACTTCTTCTACAGC
AACATCATGAACTTTTTCAAGACCGAGATTACCCTGGCCAACGGCGAGATCCGGAAGCGGCCTCTGAT
CGAGACAAACGGCGAAACCGGGGAGATCGTGTGGGATAAGGGCCGGGATTTTGCCACCGTGCGGAAA
GTGCTGAGCATGCCCCAAGTGAATATCGTGAAAAAGACCGAGGTGCAGACAGGCGGCTTCAGCAAAG
AGTCTATCCTGCCCAAGAGGAACAGCGATAAGCTGATCGCCAGAAAGAAGGACTGGGACCCTAAGAA
GTACGGCGGCTTCGACAGCCCCACCGTGGCCTATTCTGTGCTGGTGGTGGCCAAAGTGGAAAAGGGCA
AGTCCAAGAAACTGAAGAGTGTGAAAGAGCTGCTGGGGATCACCATCATGGAAAGAAGCAGCTTCGA
GAAGAATCCCATCGACTTTCTGGAAGCCAAGGGCTACAAAGAAGTGAAAAAGGACCTGATCATCAAG
CTGCCTAAGTACTCCCTGTTCGAGCTGGAAAACGGCCGGAAGAGAATGCTGGCCTCTGCCGGCGAACT
GCAGAAGGGAAACGAACTGGCCCTGCCCTCCAAATATGTGAACTTCCTGTACCTGGCCAGCCACTATG
AGAAGCTGAAGGGCTCCCCCGAGGATAATGAGCAGAAACAGCTGTTTGTGGAACAGCACAAGCACTA
CCTGGACGAGATCATCGAGCAGATCAGCGAGTTCTCCAAGAGAGTGATCCTGGCCGACGCTAATCTGG
ACAAAGTGCTGTCCGCCTACAACAAGCACCGGGATAAGCCCATCAGAGAGCAGGCCGAGAATATCAT
CCACCTGTTTACCCTGACCAATCTGGGAGCCCCTGCCGCCTTCAAGTACTTTGACACCACCATCGACCG
GAAGAGGTACACCAGCACCAAAGAGGTGCTGGACGCCACCCTGATCCACCAGAGCATCACCGGCCTG
TACGAGACACGGATCGACCTGTCTCAGCTGGGAGGCGAC<u>AAAAGGCCGGCGGCCACGAAAAAGGCCG</u>
<u>GCCAGGCAAAAAAGAAAAAG</u> (SEQ ID NO: 114)
Sp_del(97-150)
*ATGGACTATAAGGACCACGACGGAGACTACAAGGATCATGATATTGATTACAAAGACGATGACGATAAG*<u>ATGG</u>
<u>CCCCAAAGAAGAAGCGGAAGGTCGGTATCCACGGAGTCCCAGCAGCC</u>GACAAGAAGTACAGCATCGG
CCTGGACATCGGCACCAACTCTGTGGGCTGGGCCGTGATCACCGACGAGTACAAGGTGCCCAGCAAG
AAATTCAAGGTGCTGGGCAACACCGACCGGCACAGCATCAAGAAGAACCTGATCGGAGCCCTGCTGT
TCGACAGCGGCGAAACAGCCGAGGCCACCCGGCTGAAGAGAACCGCCAGAAGAAGATACACCAGAC
GGAAGAACCGGATCTGCTATCTGCAAGAGATCTTCAGCAACGAGATGGCCAAGGTGGACGACAGCCT
GCGGCTGATCTATCTGGCCCTGGCCCACATGATCAAGTTCCGGGGCCACTTCCTGATCGAGGGCGACC
TGAACCCCGACAACAGCGACGTGGACAAGCTGTTCATCCAGCTGGTGCAGACCTACAACCAGCTGTTC
```

-continued

```
GAGGAAAACCCCATCAACGCCAGCGGCGTGGACGCCAAGGCCATCCTGTCTGCCAGACTGAGCAAGA
GCAGACGGCTGGAAAATCTGATCGCCCAGCTGCCCGGCGAGAAGAAGAATGGCCTGTTCGGAAACCT
GATTGCCCTGAGCCTGGGCCTGACCCCCAACTTCAAGAGCAACTTCGACCTGGCCGAGGATGCCAAAC
TGCAGCTGAGCAAGGACACCTACGACGACGACCTGGACAACCTGCTGGCCCAGATCGGCGACCAGTA
CGCCGACCTGTTTCTGGCCGCCAAGAACCTGTCCGACGCCATCCTGCTGAGCGACATCCTGAGAGTGA
ACACCGAGATCACCAAGGCCCCCCTGAGCGCCTCTATGATCAAGAGATACGACGAGCACCACCAGGA
CCTGACCCTGCTGAAAGCTCTCGTGCGGCAGCAGCTGCCTGAGAAGTACAAAGAGATTTTCTTCGACC
AGAGCAAGAACGGCTACGCCGGCTACATTGACGGCGGAGCCAGCCAGGAAGAGTTCTACAAGTTCAT
CAAGCCCATCCTGGAAAAGATGGACGGCACCGAGGAACTGCTCGTGAAGCTGAACAGAGAGGACCTG
CTGCGGAAGCAGCGGACCTTCGACAACGGCAGCATCCCCCACCAGATCCACCTGGGAGAGCTGCACG
CCATTCTGCGGCGGCAGGAAGATTTTTACCCATTCCTGAAGGACAACCGGGAAAAGATCGAGAAGATC
CTGACCTTCCGCATCCCCTACTACGTGGGCCCTCTGGCCAGGGGAAACAGCAGATTCGCCTGGATGAC
CAGAAAGAGCGAGGAAACCATCACCCCCTGGAACTTCGAGGAAGTGGTGGACAAGGGCGCTTCCGCC
CAGAGCTTCATCGAGCGGATGACCAACTTCGATAAGAACCTGCCCAACGAGAAGGTGCTGCCCAAGC
ACAGCCTGCTGTACGAGTACTTCACCGTGTATAACGAGCTGACCAAAGTGAAATACGTGACCGAGGGA
ATGAGAAAGCCCGCCTTCCTGAGCGGCGAGCAGAAAAAGGCCATCGTGGACCTGCTGTTCAAGACCA
ACCGGAAAGTGACCGTGAAGCAGCTGAAAGAGGACTACTTCAAGAAAATCGAGTGCTTCGACTCCGT
GGAAATCTCCGGCGTGGAAGATCGGTTCAACGCCTCCCTGGGCACATACCACGATCTGCTGAAAATTA
TCAAGGACAAGGACTTCCTGGACAATGAGGAAAACGAGGACATTCTGGAAGATATCGTGCTGACCCT
GACACTGTTTGAGGACAGAGAGATGATCGAGGAACGGCTGAAAACCTATGCCCACCTGTTCGACGAC
AAAGTGATGAAGCAGCTGAAGCGGCGGAGATACACCGGCTGGGGCAGGCTGAGCCGGAAGCTGATCA
ACGGCATCCGGGACAAGCAGTCCGGCAAGACAATCCTGGATTTCCTGAAGTCCGACGGCTTCGCCAAC
AGAAACTTCATGCAGCTGATCCACGACGACAGCCTGACCTTTAAAGAGGACATCCAGAAAGCCCAGG
TGTCCGGCCAGGGCGATAGCCTGCACGAGCACATTGCCAATCTGGCCGGCAGCCCCGCCATTAAGAAG
GGCATCCTGCAGACAGTGAAGGTGGTGGACGAGCTCGTGAAAGTGATGGGCCGGCACAAGCCCGAGA
ACATCGTGATCGAAATGGCCAGAGAGAACCAGACCACCCAGAAGGGACAGAAGAACAGCCGCGAGA
GAATGAAGCGGATCGAAGAGGGCATCAAAGAGCTGGGCAGCCAGATCCTGAAAGAACACCCCGTGGA
AAACACCCAGCTGCAGAACGAGAAGCTGTACCTGTACTACCTGCAGAATGGGCGGGATATGTACGTG
GACCAGGAACTGGACATCAACCGGCTGTCCGACTACGATGTGGACCATATCGTGCCTCAGAGCTTTCT
GAAGGACGACTCCATCGACAACAAGGTGCTGACCAGAAGCGACAAGAACCGGGGCAAGAGCGACAA
CGTGCCCTCCGAAGAGGTCGTGAAGAAGATGAAGAACTACTGGCGGCAGCTGCTGAACGCCAAGCTG
ATTACCCAGAGAAAGTTCGACAATCTGACCAAGGCCGAGAGAGGCGGCCTGAGCGAACTGGATAAGG
CCGGCTTCATCAAGAGACAGCTGGTGGAAACCCGGCAGATCACAAAGCACGTGGCACAGATCCTGGA
CTCCCGGATGAACACTAAGTACGACGAGAATGACAAGCTGATCCGGGAAGTGAAAGTGATCACCCTG
AAGTCCAAGCTGGTGTCCGATTTCCGGAAGGATTTCCAGTTTTACAAAGTGCGCGAGATCAACAACTA
CCACCACGCCCACGACGCCTACCTGAACGCCGTCGTGGGAACCGCCCTGATCAAAAAGTACCCTAAGC
TGGAAAGCGAGTTCGTGTACGGCGACTACAAGGTGTACGACGTGCGGAAGATGATCGCCAAGAGCGA
GCAGGAAATCGGCAAGGCTACCGCCAAGTACTTCTTCTACAGCAACATCATGAACTTTTTCAAGACCG
AGATTACCCTGGCCAACGGCGAGATCCGGAAGCGGCCTCTGATCGAGACAAACGGCGAAACCGGGGA
GATCGTGTGGGATAAGGGCCGGGATTTTGCCACCGTGCGGAAAGTGCTGAGCATGCCCCAAGTGAATA
```

TCGTGAAAAAGACCGAGGTGCAGACAGGCGGCTTCAGCAAAGAGTCTATCCTGCCCAAGAGGAACAG

CGATAAGCTGATCGCCAGAAAGAAGGACTGGGACCCTAAGAAGTACGGCGGCTTCGACAGCCCCACC

GTGGCCTATTCTGTGCTGGTGGTGGCCAAAGTGGAAAAGGGCAAGTCCAAGAAACTGAAGAGTGTGA

AAGAGCTGCTGGGGATCACCATCATGGAAAGAAGCAGCTTCGAGAAGAATCCCATCGACTTTCTGGA

AGCCAAGGGCTACAAAGAAGTGAAAAAGGACCTGATCATCAAGCTGCCTAAGTACTCCCTGTTCGAG

CTGGAAAACGGCCGGAAGAGAATGCTGGCCTCTGCCGGCGAACTGCAGAAGGGAAACGAACTGGCCC

TGCCCCTCCAAATATGTGAACTTCCTGTACCTGGCCAGCCACTATGAGAAGCTGAAGGGCTCCCCCGAG

GATAATGAGCAGAAACAGCTGTTTGTGGAACAGCACAAGCACTACCTGGACGAGATCATCGAGCAGA

TCAGCGAGTTCTCCAAGAGAGTGATCCTGGCCGACGCTAATCTGGACAAAGTGCTGTCCGCCTACAAC

AAGCACCGGGATAAGCCCATCAGAGAGCAGGCCGAGAATATCATCCACCTGTTTACCCTGACCAATCT

GGGAGCCCCTGCCGCCTTCAAGTACTTTGACACCACCATCGACCGGAAGAGGTACACCAGCACCAAG

AGGTGCTGGACGCCACCCTGATCCACCAGAGCATCACCGGCCTGTACGAGACACGGATCGACCTGTCT

CAGCTGGGAGGCGACAAAAGGCCGGCGGCCACGAAAAAGGCCGGCCAGGCAAAAAAGAAAAAG
(SEQ ID NO: 115)

Sp_del (175-307)
ATGGACTATAAGGACCACGACGGAGACTACAAGGATCATGATATTGATTACAAAGACGATGACGATAAGATGG

CCCCAAAGAAGAAGCGGAAGGTCGGTATCCACGGAGTCCCAGCAGCCGACAAGAAGTACAGCATCGG

CCTGGACATCGGCACCAACTCTGTGGGCTGGGCCGTGATCACCGACGAGTACAAGGTGCCCAGCAAG

AAATTCAAGGTGCTGGGCAACACCGACCGGCACAGCATCAAGAAGAACCTGATCGGAGCCCTGCTGT

TCGACAGCGGCGAAACAGCCGAGGCCACCCGGCTGAAGAGAACCGCCAGAAGAAGATACACCAGAC

GGAAGAACCGGATCTGCTATCTGCAAGAGATCTTCAGCAACGAGATGGCCAAGGTGGACGACAGCTT

CTTCCACAGACTGGAAGAGTCCTTCCTGGTGGAAGAGGATAAGAAGCACGAGCGGCACCCCATCTTCG

GCAACATCGTGGACGAGGTGGCCTACCACGAGAAGTACCCCACCATCTACCACCTGAGAAAGAAACT

GGTGGACAGCACCGACAAGGCCGACCTGCGGCTGATCTATCTGGCCCTGGCCCACATGATCAAGTTCC

GGGGCCACTTCCTGATCGAGGGCGACCTGGTGAACACCGAGATCACCAAGGCCCCCCTGAGCGCCTCT

ATGATCAAGAGATACGACGAGCACCACCAGGACCTGACCCTGCTGAAAGCTCTCGTGCGGCAGCAGC

TGCCTGAGAAGTACAAAGAGATTTTCTTCGACCAGAGCAAGAACGGCTACGCCGGCTACATTGACGGC

GGAGCCAGCCAGGAAGAGTTCTACAAGTTCATCAAGCCCATCCTGGAAAAGATGGACGGCACCGAGG

AACTGCTCGTGAAGCTGAACAGAGAGGACCTGCTGCGGAAGCAGCGGACCTTCGACAACGGCAGCAT

CCCCCACCAGATCCACCTGGGAGAGCTGCACGCCATTCTGCGGCGGCAGGAAGATTTTTACCCATTCC

TGAAGGACAACCGGGAAAAGATCGAGAAGATCCTGACCTTCCGCATCCCCTACTACGTGGGCCCTCTG

GCCAGGGGAAACAGCAGATTCGCCTGGATGACCAGAAAGAGCGAGGAAACCATCACCCCCTGGAACT

TCGAGGAAGTGGTGGACAAGGGCGCTTCCGCCCAGAGCTTCATCGAGCGGATGACCAACTTCGATAA

GAACCTGCCCAACGAGAAGGTGCTGCCCAAGCACAGCCTGCTGTACGAGTACTTCACCGTGTATAACG

AGCTGACCAAAGTGAAATACGTGACCGAGGGAATGAGAAAGCCCGCCTTCCTGAGCGGCGAGCAGAA

AAAGGCCATCGTGGACCTGCTGTTCAAGACCAACCGGAAAGTGACCGTGAAGCAGCTGAAAGAGGAC

TACTTCAAGAAAATCGAGTGCTTCGACTCCGTGGAAATCTCCGGCGTGGAAGATCGGTTCAACGCCTC

CCTGGGCACATACCACGATCTGCTGAAAATTATCAAGGACAAGGACTTCCTGGACAATGAGGAAAAC

GAGGACATTCTGGAAGATATCGTGCTGACCCTGACACTGTTTGAGGACAGAGAGATGATCGAGGAAC

GGCTGAAAACCTATGCCCACCTGTTCGACGACAAAGTGATGAAGCAGCTGAAGCGGCGGAGATACAC

-continued

CGGCTGGGGCAGGCTGAGCCGGAAGCTGATCAACGGCATCCGGGACAAGCAGTCCGGCAAGACAATC

CTGGATTTCCTGAAGTCCGACGGCTTCGCCAACAGAAACTTCATGCAGCTGATCCACGACGACAGCCT

GACCTTTAAAGAGGACATCCAGAAAGCCCAGGTGTCCGGCCAGGGCGATAGCCTGCACGAGCACATT

GCCAATCTGGCCGGCAGCCCCGCCATTAAGAAGGGCATCCTGCAGACAGTGAAGGTGGTGGACGAGC

TCGTGAAAGTGATGGGCCGGCACAAGCCCGAGAACATCGTGATCGAAATGGCCAGAGAGAACCAGAC

CACCCAGAAGGGACAGAAGAACAGCCGCGAGAGAATGAAGCGGATCGAAGAGGGCATCAAAGAGCT

GGGCAGCCAGATCCTGAAAGAACACCCCGTGGAAAACACCCAGCTGCAGAACGAGAAGCTGTACCTG

TACTACCTGCAGAATGGGCGGGATATGTACGTGGACCAGGAACTGGACATCAACCGGCTGTCCGACTA

CGATGTGGACCATATCGTGCCTCAGAGCTTTCTGAAGGACGACTCCATCGACAACAAGGTGCTGACCA

GAAGCGACAAGAACCGGGGCAAGAGCGACAACGTGCCCTCCGAAGAGGTCGTGAAGAAGATGAAGA

ACTACTGGCGGCAGCTGCTGAACGCCAAGCTGATTACCCAGAGAAAGTTCGACAATCTGACCAAGGCC

GAGAGAGGCGGCCTGAGCGAACTGGATAAGGCCGGCTTCATCAAGAGACAGCTGGTGGAAACCCGGC

AGATCACAAAGCACGTGGCACAGATCCTGGACTCCCGGATGAACACTAAGTACGACGAGAATGACAA

GCTGATCCGGGAAGTGAAAGTGATCACCCTGAAGTCCAAGCTGGTGTCCGATTTCCGGAAGGATTTCC

AGTTTTACAAAGTGCGCGAGATCAACAACTACCACCACGCCCACGACGCCTACCTGAACGCCGTCGTG

GGAACCGCCCTGATCAAAAAGTACCCTAAGCTGGAAAGCGAGTTCGTGTACGGCGACTACAAGGTGT

ACGACGTGCGGAAGATGATCGCCAAGAGCGAGCAGGAAATCGGCAAGGCTACCGCCAAGTACTTCTT

CTACAGCAACATCATGAACTTTTTCAAGACCGAGATTACCCTGGCCAACGGCGAGATCCGGAAGCGGC

CTCTGATCGAGACAAACGGCGAAACCGGGGAGATCGTGTGGGATAAGGGCCGGGATTTTGCCACCGT

GCGGAAAGTGCTGAGCATGCCCCAAGTGAATATCGTGAAAAAGACCGAGGTGCAGACAGGCGGCTTC

AGCAAAGAGTCTATCCTGCCCAAGAGGAACAGCGATAAGCTGATCGCCAGAAAGAAGGACTGGGACC

CTAAGAAGTACGGCGGCTTCGACAGCCCCACCGTGGCCTATTCTGTGCTGGTGGTGGCCAAAGTGGAA

AAGGGCAAGTCCAAGAAACTGAAGAGTGTGAAAGAGCTGCTGGGGATCACCATCATGGAAAGAAGCA

GCTTCGAGAAGAATCCCATCGACTTTCTGGAAGCCAAGGGCTACAAAGAAGTGAAAAAGGACCTGAT

CATCAAGCTGCCTAAGTACTCCCTGTTCGAGCTGGAAAACGGCCGGAAGAGAATGCTGGCCTCTGCCG

GCGAACTGCAGAAGGGAAACGAACTGGCCCTGCCCTCCAAATATGTGAACTTCCTGTACCTGGCCAGC

CACTATGAGAAGCTGAAGGGCTCCCCCGAGGATAATGAGCAGAAACAGCTGTTTGTGGAACAGCACA

AGCACTACCTGGACGAGATCATCGAGCAGATCAGCGAGTTCTCCAAGAGAGTGATCCTGGCCGACGCT

AATCTGGACAAAGTGCTGTCCGCCTACAACAAGCACCGGGATAAGCCCATCAGAGAGCAGGCCGAGA

ATATCATCCACCTGTTTACCCTGACCAATCTGGGAGCCCCTGCCGCCTTCAAGTACTTTGACACCACCA

TCGACCGGAAGAGGTACACCAGCACCAAAGAGGTGCTGGACGCCACCCTGATCCACCAGAGCATCAC

CGGCCTGTACGAGACACGGATCGACCTGTCTCAGCTGGGAGGCGAC<u>AAAAGGCCGGCGGCCACGAAA</u>

<u>AAGGCCGGCCAGGCAAAAAAGAAAAAG</u> (SEQ ID NO: 116)

Sp_del(312-409)
*ATGGACTATAAGGACCACGACGGAGACTACAAGGATCATGATATTGATTACAAAGACGATGACGATAAG*<u>ATGG</u>

<u>CCCCAAAGAAGAAGCGGAAGGTCGGTATCCACGGAGTCCCAGCAGCC</u>GACAAGAAGTACAGCATCGG

CCTGGACATCGGCACCAACTCTGTGGGCTGGGCCGTGATCACCGACGAGTACAAGGTGCCCAGCAAG

AAATTCAAGGTGCTGGGCAACACCGACCGGCACAGCATCAAGAAGAACCTGATCGGAGCCCTGCTGT

TCGACAGCGGCGAAACAGCCGAGGCCACCCGGCTGAAGAGAACCGCCAGAAGAAGATACACCAGAC

GGAAGAACCGGATCTGCTATCTGCAAGAGATCTTCAGCAACGAGATGGCCAAGGTGGACGACAGCTT

```
CTTCCACAGACTGGAAGAGTCCTTCCTGGTGGAAGAGGATAAGAAGCACGAGCGGCACCCCATCTTCG
GCAACATCGTGGACGAGGTGGCCTACCACGAGAAGTACCCCACCATCTACCACCTGAGAAAGAAACT
GGTGGACAGCACCGACAAGGCCGACCTGCGGCTGATCTATCTGGCCCTGGCCCACATGATCAAGTTCC
GGGGCCACTTCCTGATCGAGGGCGACCTGAACCCCGACAACAGCGACGTGGACAAGCTGTTCATCCAG
CTGGTGCAGACCTACAACCAGCTGTTCGAGGAAAACCCCATCAACGCCAGCGGCGTGGACGCCAAGG
CCATCCTGTCTGCCAGACTGAGCAAGAGCAGACGGCTGGAAAATCTGATCGCCCAGCTGCCCGGCGAG
AAGAAGAATGGCCTGTTCGGAAACCTGATTGCCCTGAGCCTGGGCCTGACCCCCAACTTCAAGAGCAA
CTTCGACCTGGCCGAGGATGCCAAACTGCAGCTGAGCAAGGACACCTACGACGACGACCTGGACAAC
CTGCTGGCCCAGATCGGCGACCAGTACGCCGACCTGTTTCTGGCCGCCAAGAACCTGTCCGACGCCAT
CCTGCTGAGCGACATCCTGAGAGTGAACACCGAGATCCCCCACCAGATCCACCTGGGAGAGCTGCACG
CCATTCTGCGGCGGCAGGAAGATTTTTACCCATTCCTGAAGGACAACCGGGAAAAGATCGAGAAGATC
CTGACCTTCCGCATCCCCTACTACGTGGGCCCTCTGGCCAGGGGAAACAGCAGATTCGCCTGGATGAC
CAGAAAGAGCGAGGAAACCATCACCCCCTGGAACTTCGAGGAAGTGGTGGACAAGGGCGCTTCCGCC
CAGAGCTTCATCGAGCGGATGACCAACTTCGATAAGAACCTGCCCAACGAGAAGGTGCTGCCCAAGC
ACAGCCTGCTGTACGAGTACTTCACCGTGTATAACGAGCTGACCAAAGTGAAATACGTGACCGAGGGA
ATGAGAAAGCCCGCCTTCCTGAGCGGCGAGCAGAAAAAGGCCATCGTGGACCTGCTGTTCAAGACCA
ACCGGAAAGTGACCGTGAAGCAGCTGAAAGAGGACTACTTCAAGAAAATCGAGTGCTTCGACTCCGT
GGAAATCTCCGGCGTGGAAGATCGGTTCAACGCCTCCCTGGGCACATACCACGATCTGCTGAAAATTA
TCAAGGACAAGGACTTCCTGGACAATGAGGAAAACGAGGACATTCTGGAAGATATCGTGCTGACCCT
GACACTGTTTGAGGACAGAGAGATGATCGAGGAACGGCTGAAAACCTATGCCCACCTGTTCGACGAC
AAAGTGATGAAGCAGCTGAAGCGGCGGAGATACACCGGCTGGGGCAGGCTGAGCCGGAAGCTGATCA
ACGGCATCCGGGACAAGCAGTCCGGCAAGACAATCCTGGATTTCCTGAAGTCCGACGGCTTCGCCAAC
AGAAACTTCATGCAGCTGATCCACGACGACAGCCTGACCTTTAAAGAGGACATCCAGAAAGCCCAGG
TGTCCGGCCAGGGCGATAGCCTGCACGAGCACATTGCCAATCTGGCCGGCAGCCCCGCCATTAAGAAG
GGCATCCTGCAGACAGTGAAGGTGGTGGACGAGCTCGTGAAAGTGATGGGCCGGCACAAGCCCGAGA
ACATCGTGATCGAAATGGCCAGAGAGAACCAGACCACCCAGAAGGGACAGAAGAACAGCCGCGAGA
GAATGAAGCGGATCGAAGAGGGCATCAAAGAGCTGGGCAGCCAGATCCTGAAAGAACACCCCGTGGA
AAACACCCAGCTGCAGAACGAGAAGCTGTACCTGTACTACCTGCAGAATGGCCGGGATATGTACGTG
GACCAGGAACTGGACATCAACCGGCTGTCCGACTACGATGTGGACCATATCGTGCCTCAGAGCTTTCT
GAAGGACGACTCCATCGACAACAAGGTGCTGACCAGAAGCGACAAGAACCGGGGCAAGAGCGACAA
CGTGCCCTCCGAAGAGGTCGTGAAGAAGATGAAGAACTACTGGCGGCAGCTGCTGAACGCCAAGCTG
ATTACCCAGAGAAAGTTCGACAATCTGACCAAGGCCGAGAGAGGCGGCCTGAGCGAACTGGATAAGG
CCGGCTTCATCAAGAGACAGCTGGTGGAAACCCGGCAGATCACAAAGCACGTGGCACAGATCCTGGA
CTCCCGGATGAACACTAAGTACGACGAGAATGACAAGCTGATCCGGGAAGTGAAAGTGATCACCCTG
AAGTCCAAGCTGGTGTCCGATTTCCGGAAGGATTTCCAGTTTTACAAAGTGCGCGAGATCAACAACTA
CCACCACGCCCACGACGCCTACCTGAACGCCGTCGTGGGAACCGCCCTGATCAAAAAGTACCCTAAGC
TGGAAAGCGAGTTCGTGTACGGCGACTACAAGGTGTACGACGTGCGGAAGATGATCGCCAAGAGCGA
GCAGGAAATCGGCAAGGCTACCGCCAAGTACTTCTTCTACAGCAACATCATGAACTTTTTCAAGACCG
AGATTACCCTGGCCAACGGCGAGATCCGGAAGCGGCCTCTGATCGAGACAAACGGCGAAACCGGGGA
GATCGTGTGGGATAAGGGCCGGGATTTTGCCACCGTGCGGAAAGTGCTGAGCATGCCCCAAGTGAATA
```

TCGTGAAAAAGACCGAGGTGCAGACAGGCGGCTTCAGCAAAGAGTCTATCCTGCCCAAGAGGAACAG

CGATAAGCTGATCGCCAGAAAGAAGGACTGGGACCCTAAGAAGTACGGCGGCTTCGACAGCCCCACC

GTGGCCTATTCTGTGCTGGTGGTGGCCAAAGTGGAAAAGGGCAAGTCCAAGAAACTGAAGAGTGTGA

AAGAGCTGCTGGGGATCACCATCATGGAAAGAAGCAGCTTCGAGAAGAATCCCATCGACTTTCTGGA

AGCCAAGGGCTACAAAGAAGTGAAAAAGGACCTGATCATCAAGCTGCCTAAGTACTCCCTGTTCGAG

CTGGAAAACGGCCGGAAGAGAATGCTGGCCTCTGCCGGCGAACTGCAGAAGGGAAACGAACTGGCCC

TGCCCTCCAAATATGTGAACTTCCTGTACCTGGCCAGCCACTATGAGAAGCTGAAGGGCTCCCCCGAG

GATAATGAGCAGAAACAGCTGTTTGTGGAACAGCACAAGCACTACCTGGACGAGATCATCGAGCAGA

TCAGCGAGTTCTCCAAGAGAGTGATCCTGGCCGACGCTAATCTGGACAAAGTGCTGTCCGCCTACAAC

AAGCACCGGGATAAGCCCATCAGAGAGCAGGCCGAGAATATCATCCACCTGTTTACCCTGACCAATCT

GGGAGCCCCTGCCGCCTTCAAGTACTTTGACACCACCATCGACCGGAAGAGGTACACCAGCACCAAAG

AGGTGCTGGACGCCACCCTGATCCACCAGAGCATCACCGGCCTGTACGAGACACGGATCGACCTGTCT

CAGCTGGGAGGCGAC<u>AAAAGGCCGGCGGCCACGAAAAAGGCCGGCCAGGCAAAAAAGAAAAAG</u>
(SEQ ID NO: 117)

Sp_del (1098-end)
*ATGGACTATAAGGACCACGACGGAGACTACAAGGATCATGATATTGATTACAAAGACGATGACGATAAG*<u>ATGG</u>

<u>CCCCAAAGAAGAAGCGGAAGGTCGGTATCCACGGAGTCCCAGCAGCC</u>GACAAGAAGTACAGCATCGG

CCTGGACATCGGCACCAACTCTGTGGGCTGGGCCGTGATCACCGACGAGTACAAGGTGCCCAGCAAG

AAATTCAAGGTGCTGGGCAACACCGACCGGCACAGCATCAAGAAGAACCTGATCGGAGCCCTGCTGT

TCGACAGCGGCGAAACAGCCGAGGCCACCCGGCTGAAGAGAACCGCCAGAAGAAGATACACCAGAC

GGAAGAACCGGATCTGCTATCTGCAAGAGATCTTCAGCAACGAGATGGCCAAGGTGGACGACAGCTT

CTTCCACAGACTGGAAGAGTCCTTCCTGGTGGAAGAGGATAAGAAGCACGAGCGGCACCCCATCTTCG

GCAACATCGTGGACGAGGTGGCCTACCACGAGAAGTACCCCACCATCTACCACCTGAGAAAGAAACT

GGTGGACAGCACCGACAAGGCCGACCTGCGGCTGATCTATCTGGCCCTGGCCCACATGATCAAGTTCC

GGGGCCACTTCCTGATCGAGGGCGACCTGAACCCCGACAACAGCGACGTGGACAAGCTGTTCATCCAG

CTGGTGCAGACCTACAACCAGCTGTTCGAGGAAAACCCCATCAACGCCAGCGGCGTGGACGCCAAGG

CCATCCTGTCTGCCAGACTGAGCAAGAGCAGACGGCTGGAAAATCTGATCGCCCAGCTGCCCGGCGAG

AAGAAGAATGGCCTGTTCGGAAACCTGATTGCCCTGAGCCTGGGCCTGACCCCCAACTTCAAGAGCAA

CTTCGACCTGGCCGAGGATGCCAAACTGCAGCTGAGCAAGGACACCTACGACGACGACCTGGACAAC

CTGCTGGCCCAGATCGGCGACCAGTACGCCGACCTGTTTCTGGCCGCCAAGAACCTGTCCGACGCCAT

CCTGCTGAGCGACATCCTGAGAGTGAACACCGAGATCACCAAGGCCCCCCTGAGCGCCTCTATGATCA

AGAGATACGACGAGCACCACCAGGACCTGACCCTGCTGAAAGCTCTCGTGCGGCAGCAGCTGCCTGA

GAAGTACAAAGAGATTTTCTTCGACCAGAGCAAGAACGGCTACGCCGGCTACATTGACGGCGGAGCC

AGCCAGGAAGAGTTCTACAAGTTCATCAAGCCCATCCTGGAAAAGATGGACGGCACCGAGGAACTGC

TCGTGAAGCTGAACAGAGAGGACCTGCTGCGGAAGCAGCGGACCTTCGACAACGGCAGCATCCCCCA

CCAGATCCACCTGGGAGAGCTGCACGCCATTCTGCGGCGGCAGGAAGATTTTTACCCATTCCTGAAGG

ACAACCGGGAAAAGATCGAGAAGATCCTGACCTTCCGCATCCCCTACTACGTGGGCCCTCTGGCCAGG

GGAAACAGCAGATTCGCCTGGATGACCAGAAAGAGCGAGGAAACCATCACCCCCTGGAACTTCGAGG

AAGTGGTGGACAAGGGCGCTTCCGCCCAGAGCTTCATCGAGCGGATGACCAACTTCGATAAGAACCTG

CCCAACGAGAAGGTGCTGCCCAAGCACAGCCTGCTGTACGAGTACTTCACCGTGTATAACGAGCTGAC

-continued

```
CAAAGTGAAATACGTGACCGAGGGAATGAGAAAGCCCGCCTTCCTGAGCGGCGAGCAGAAAAAGGCC

ATCGTGGACCTGCTGTTCAAGACCAACCGGAAAGTGACCGTGAAGCAGCTGAAAGAGGACTACTTCA

AGAAAATCGAGTGCTTCGACTCCGTGGAAATCTCCGGCGTGGAAGATCGGTTCAACGCCTCCCTGGGC

ACATACCACGATCTGCTGAAAATTATCAAGGACAAGGACTTCCTGGACAATGAGGAAAACGAGGACA

TTCTGGAAGATATCGTGCTGACCCTGACACTGTTTGAGGACAGAGAGATGATCGAGGAACGGCTGAAA

ACCTATGCCCACCTGTTCGACGACAAAGTGATGAAGCAGCTGAAGCGGCGGAGATACACCGGCTGGG

GCAGGCTGAGCCGGAAGCTGATCAACGGCATCCGGGACAAGCAGTCCGGCAAGACAATCCTGGATTT

CCTGAAGTCCGACGGCTTCGCCAACAGAAACTTCATGCAGCTGATCCACGACGACAGCCTGACCTTTA

AGAGGACATCCAGAAAGCCCAGGTGTCCGGCCAGGGCGATAGCCTGCACGAGCACATTGCCAATCT

GGCCGGCAGCCCCGCCATTAAGAAGGGCATCCTGCAGACAGTGAAGGTGGTGGACGAGCTCGTGAAA

GTGATGGGCCGGCACAAGCCCGAGAACATCGTGATCGAAATGGCCAGAGAGAACCAGACCACCCAGA

AGGGACAGAAGAACAGCCGCGAGAGAATGAAGCGGATCGAAGAGGGCATCAAAGAGCTGGGCAGCC

AGATCCTGAAAGAACACCCCGTGGAAAACACCCAGCTGCAGAACGAGAAGCTGTACCTGTACTACCT

GCAGAATGGGCGGGATATGTACGTGGACCAGGAACTGGACATCAACCGGCTGTCCGACTACGATGTG

GACCATATCGTGCCTCAGAGCTTTCTGAAGGACGACTCCATCGACAACAAGGTGCTGACCAGAAGCGA

CAAGAACCGGGGCAAGAGCGACAACGTGCCCTCCGAAGAGGTCGTGAAGAAGATGAAGAACTACTGG

CGGCAGCTGCTGAACGCCAAGCTGATTACCCAGAGAAAGTTCGACAATCTGACCAAGGCCGAGAGAG

GCGGCCTGAGCGAACTGGATAAGGCCGGCTTCATCAAGAGACAGCTGGTGGAAACCCGGCAGATCAC

AAAGCACGTGGCACAGATCCTGGACTCCCGGATGAACACTAAGTACGACGAGAATGACAAGCTGATC

CGGGAAGTGAAAGTGATCACCCTGAAGTCCAAGCTGGTGTCCGATTTCCGGAAGGATTTCCAGTTTTA

CAAAGTGCGCGAGATCAACAACTACCACCACGCCCACGACGCCTACCTGAACGCCGTCGTGGGAACC

GCCCTGATCAAAAAGTACCCTAAGCTGGAAAGCGAGTTCGTGTACGGCGACTACAAGGTGTACGACGT

GCGGAAGATGATCGCCAAGAGCGAGCAGGAAATCGGCAAGGCTACCGCCAAGTACTTCTTCTACAGC

AACATCATGAACTTTTTCAAGACCGAGATTACCCTGGCCAACGGCGAGATCCGGAAGCGGCCTCTGAT

CGAGACAAACGGCGAAACCGGGGAGATCGTGTGGGATAAGGGCCGGGATTTTGCCACCGTGCGGAAA

GTGCTGAGCATGCCCCAAGTGAATATCGTGAAAAAGACCAAAAGGCCGGCGGCCACGAAAAAGGCCG

GCCAGGCAAAAAAGAAAAAG (SEQ ID NO: 118)
```

St3Cas9
```
ATGGACTATAAGGACCACGACGGAGACTACAAGGATCATGATATTGATTACAAAGACGATGACGATAAGATGG

CCCCAAAGAAGAAGCGGAAGGTCGGTATCCACGGAGTCCCAGCAGCCACCAAGCCCTACAGCATCGG

CCTGGACATCGGCACCAATAGCGTGGGCTGGGCCGTGACCACCGACAACTACAAGGTGCCCAGCAAG

AAAATGAAGGTGCTGGGCAACACCTCCAAGAAGTACATCAAGAAAAACCTGCTGGGCGTGCTGCTGT

TCGACAGCGGCATTACAGCCGAGGGCAGACGGCTGAAGAGAACCGCCAGACGGCGGTACACCCGGCG

GAGAAACAGAATCCTGTATCTGCAAGAGATCTTCAGCACCGAGATGGCTACCCTGGACGACGCCTTCT

TCCAGCGGCTGGACGACAGCTTCCTGGTGCCCGACGACAAGCGGGACAGCAAGTACCCCATCTTCGGC

AACCTGGTGGAAGAGAAGGCCTACCACGACGAGTTCCCCACCATCTACCACCTGAGAAAGTACCTGGC

CGACAGCACCAAGAAGGCCGACCTGAGACTGGTGTATCTGGCCCTGGCCCACATGATCAAGTACCGG

GGCCACTTCCTGATCGAGGGCGAGTTCAACAGCAAGAACAACGACATCCAGAAGAACTTCCAGGACT

TCCTGGACACCTACAACGCCATCTTCGAGAGCGACCTGTCCCTGGAAAACAGCAAGCAGCTGGAAGA

GATCGTGAAGGACAAGATCAGCAAGCTGGAAAAGAAGGACCGCATCCTGAAGCTGTTCCCCGGCGAG
```

-continued

```
AAGAACAGCGGAATCTTCAGCGAGTTTCTGAAGCTGATCGTGGGCAACCAGGCCGACTTCAGAAAGT
GCTTCAACCTGGACGAGAAAGCCAGCCTGCACTTCAGCAAAGAGAGCTACGACGAGGACCTGGAAAC
CCTGCTGGGATATATCGGCGACGACTACAGCGACGTGTTCCTGAAGGCCAAGAAGCTGTACGACGCTA
TCCTGCTGAGCGGCTTCCTGACCGTGACCGACAACGAGACAGAGGCCCCACTGAGCAGCGCCATGATT
AAGCGGTACAACGAGCACAAAGAGGATCTGGCTCTGCTGAAAGAGTACATCCGGAACATCAGCCTGA
AAACCTACAATGAGGTGTTCAAGGACGACACCAAGAACGGCTACGCCGGCTACATCGACGGCAAGAC
CAACCAGGAAGAGGAAGATTTCTATGTGTACCTGAAGAAGCTGCTGGCCGAGTTCGAGGGGCCGAC
TACTTTCTGGAAAAAATCGACCGCGAGGATTTCCTGCGGAAGCAGCGGACCTTCGACAACGGCAGCAT
CCCCTACCAGATCCATCTGCAGGAAATGCGGGCCATCCTGGACAAGCAGGCCAAGTTCTACCCATTCC
TGGCCAAGAACAAAGAGCGGATCGAGAAGATCCTGACCTTCCGCATCCCTTACTACGTGGGCCCCCTG
GCCAGAGGCAACAGCGATTTTGCCTGGTCCATCCGGAAGCGCAATGAGAAGATCACCCCCTGGAACTT
CGAGGACGTGATCGACAAGAGTCCAGCGCCGAGGCCTTCATCAACCGGATGACCAGCTTCGACCTGT
ACCTGCCCGAGGAAAAGGTGCTGCCCAAGCACAGCCTGCTGTACGAGACATTCAATGTGTATAACGAG
CTGACCAAAGTGCGGTTTATCGCCGAGTCTATGCGGGACTACCAGTTCCTGGACTCCAAGCAGAAAAA
GGACATCGTGCGGCTGTACTTCAAGGACAAGCGGAAAGTGACCGATAAGGACATCATCGAGTACCTG
CACGCCATCTACGGCTACGATGGCATCGAGCTGAAGGGCATCGAGAAGCAGTTCAACTCCAGCCTGAG
CACATACCACGACCTGCTGAACATTATCAACGACAAAGAATTTCTGGACGACTCCAGCAACGAGGCCA
TCATCGAAGAGATCATCCACACCCTGACCATCTTTGAGGACCGCGAGATGATCAAGCAGCGGCTGAGC
AAGTTCGAGAACATCTTCGACAAGAGCGTGCTGAAAAAGCTGAGCAGACGGCACTACACCGGCTGGG
GCAAGCTGAGCGCCAAGCTGATCAACGGCATCCGGGACGAGAAGTCCGGCAACACAATCCTGGACTA
CCTGATCGACGACGGCATCAGCAACCGGAACTTCATGCAGCTGATCCACGACGACGCCCTGAGCTTCA
AGAAGAAGATCCAGAAGGCCCAGATCATCGGGGACGAGGACAAGGGCAACATCAAAGAAGTCGTGA
AGTCCCTGCCCGGCAGCCCCGCCATCAAGAAGGGAATCCTGCAGAGCATCAAGATCGTGGACGAGCT
CGTGAAAGTGATGGGCGGCAGAAAGCCCGAGAGCATCGTGGTGGTGGTGGAAATGGCTAGAGAGAAC
CAGTACACCAATCAGGGCAAGAGCAACAGCCAGCAGAGACTGAAGAGACTGGAAAAGTCCCTGAAA
GAGCTGGGCAGCAAGATTCTGAAAGAGAATATCCCTGCCAAGCTGTCCAAGATCGACAACAACGCCC
TGCAGAACGACCGGCTGTACCTGTACTACCTGCAGAATGGCAAGGACATGTATACAGGCGACGACCTG
GATATCGACCGCCTGAGCAACTACGACATCGACCATATTATCCCCCAGGCCTTCCTGAAAGACAACAG
CATTGACAACAAAGTGCTGGTGTCCTCCGCCAGCAACCGCGGCAAGTCCGATGATGTGCCCAGCCTGG
AAGTCGTGAAAAAGAGAAAGACCTTCTGGTATCAGCTGCTGAAAAGCAAGCTGATTAGCCAGAGGAA
GTTCGACAACCTGACCAAGGCCGAGAGGGCGGCCTGAGCCCTGAAGATAAGGCCGGCTTCATCCAG
AGACAGCTGGTGGAAACCCGGCAGATCACCAAGCACGTGGCCAGACTGCTGGATGAGAAGTTTAACA
ACAAGAAGGACGAGAACAACCGGGCCGTGCGGACCGTGAAGATCATCACCCTGAAGTCCACCCTGGT
GTCCCAGTTCCGGAAGGACTTCGAGCTGTATAAAGTGCGCGAGATCAATGACTTTCACCACGCCCACG
ACGCCTACCTGAATGCCGTGGTGGCTTCCGCCCTGCTGAAGAAGTACCCTAAGCTGGAACCCGAGTTC
GTGTACGGCGACTACCCCAAGTACAACTCCTTCAGAGAGCGGAAGTCCGCCACCGAGAAGGTGTACTT
CTACTCCAACATCATGAATATCTTTAAGAAGTCCATCTCCCTGGCCGATGGCAGAGTGATCGAGCGGC
CCCTGATCGAAGTGAACGAAGAGACAGGCGAGAGCGTGTGGAACAAAGAAAGCGACCTGGCCACCGT
GCGGCGGGTGCTGAGTTATCCTCAAGTGAATGTCGTGAAGAAGGTGGAAGAACAGAACCACGGCCTG
GATCGGGGCAAGCCCAAGGGCCTGTTCAACGCCAACCTGTCCAGCAAGCCTAAGCCCAACTCCAACG
```

AGAATCTCGTGGGGGCCAAAGAGTACCTGGACCCTAAGAAGTACGGGTACGGCGGATACGCCGGCAT

CTCCAATAGCTTCACCGTGCTCGTGAAGGGCACAATCGAGAAGGGCGCTAAGAAAAAGATCACAAAC

GTGCTGGAATTTCAGGGGATCTCTATCCTGGACCGGATCAACTACCGGAAGGATAAGCTGAACTTTCT

GCTGGAAAAAGGCTACAAGGACATTGAGCTGATTATCGAGCTGCCTAAGTACTCCCTGTTCGAACTGA

GCGACGGCTCCAGACGGATGCTGGCCTCCATCCTGTCCACCAACAACAAGCGGGGCGAGATCCACAA

GGGAAACCAGATCTTCCTGAGCCAGAAATTTGTGAAACTGCTGTACCACGCCAAGCGGATCTCCAACA

CCATCAATGAGAACCACCGGAAATACGTGGAAAACCACAAGAAAGAGTTTGAGGAACTGTTCTACTA

CATCCTGGAGTTCAACGAGAACTATGTGGGAGCCAAGAAGAACGGCAAACTGCTGAACTCCGCCTTCC

AGAGCTGGCAGAACCACAGCATCGACGAGCTGTGCAGCTCCTTCATCGGCCCTACCGGCAGCGAGCG

GAAGGGACTGTTTGAGCTGACCTCCAGAGGCTCTGCCGCCGACTTTGAGTTCCTGGGAGTGAAGATCC

CCCGGTACAGAGACTACACCCCCTCTAGTCTGCTGAAGGACGCCACCCTGATCCACCAGAGCGTGACC

GGCCTGTACGAAACCCGGATCGACCTGGCTAAGCTGGGCGAGGGAAAAAGGCCGGCGGCCACGAAAA

AGGCCGGCCAGGCAAAAAAGAAAAAG (SEQ ID NO: 119)

SpCas9(C80L, C574A)
ATGGACAAGAAGTACAGCATCGGCCTGGACATCGGCACCAACTCTGTGGGCTGGGCCGTGATCACCG

ACGAGTACAAGGTGCCCAGCAAGAAATTCAAGGTGCTGGGCAACACCGACCGGCACAGCATCAAGAA

GAACCTGATCGGAGCCCTGCTGTTCGACAGCGGCGAAACAGCCGAGGCCACCCGGCTGAAGAGAACC

GCCAGAAGAAGATACACCAGACGGAAGAACCGGATCctgTATCTGCAAGAGATCTTCAGCAACGAGAT

GGCCAAGGTGGACGACAGCTTCTTCCACAGACTGGAAGAGTCCTTCCTGGTGGAAGAGGATAAGAAG

CACGAGCGGCACCCCATCTTCGGCAACATCGTGGACGAGGTGGCCTACCACGAGAAGTACCCCACCAT

CTACCACCTGAGAAAGAAACTGGTGGACAGCACCGACAAGGCCGACCTGCGGCTGATCTATCTGGCCC

TGGCCCACATGATCAAGTTCCGGGGCCACTTCCTGATCGAGGGCGACCTGAACCCCGACAACAGCGAC

GTGGACAAGCTGTTCATCCAGCTGGTGCAGACCTACAACCAGCTGTTCGAGGAAAACCCCATCAACGC

CAGCGGCGTGGACGCCAAGGCCATCCTGTCTGCCAGACTGAGCAAGAGCAGACGGCTGGAAAATCTG

ATCGCCCAGCTGCCCGGCGAGAAGAAGAATGGCCTGTTCGGAAACCTGATTGCCCTGAGCCTGGGCCT

GACCCCCAACTTCAAGAGCAACTTCGACCTGGCCGAGGATGCCAAACTGCAGCTGAGCAAGGACACC

TACGACGACGACCTGGACAACCTGCTGGCCCAGATCGGCGACCAGTACGCCGACCTGTTTCTGGCCGC

CAAGAACCTGTCCGACGCCATCCTGCTGAGCGACATCCTGAGAGTGAACACCGAGATCACCAAGGCCC

CCCTGAGCGCCTCTATGATCAAGAGATACGACGAGCACCACCAGGACCTGACCCTGCTGAAAGCTCTC

GTGCGGCAGCAGCTGCCTGAGAAGTACAAAGAGATTTTCTTCGACCAGAGCAAGAACGGCTACGCCG

GCTACATTGACGGCGGAGCCAGCCAGGAAGAGTTCTACAAGTTCATCAAGCCCATCCTGGAAAAGAT

GGACGGCACCGAGGAACTGCTCGTGAAGCTGAACAGAGAGGACCTGCTGCGGAAGCAGCGGACCTTC

GACAACGGCAGCATCCCCCACCAGATCCACCTGGGAGAGCTGCACGCCATTCTGCGGCGGCAGGAAG

ATTTTTACCCATTCCTGAAGGACAACCGGGAAAAGATCGAGAAGATCCTGACCTTCCGCATCCCCTAC

TACGTGGGCCCTCTGGCCAGGGGAAACAGCAGATTCGCCTGGATGACCAGAAAGAGCGAGGAAACCA

TCACCCCCTGGAACTTCGAGGAAGTGGTGGACAAGGGCGCTTCCGCCCAGAGCTTCATCGAGCGGATG

ACCAACTTCGATAAGAACCTGCCCAACGAGAAGGTGCTGCCCAAGCACAGCCTGCTGTACGAGTACTT

CACCGTGTATAACGAGCTGACCAAAGTGAAATACGTGACCGAGGGAATGAGAAAGCCCGCCTTCCTG

AGCGGCGAGCAGAAAAAGGCCATCGTGGACCTGCTGTTCAAGACCAACCGGAAAGTGACCGTGAAGC

AGCTGAAAGAGGACTACTTCAAGAAAATCGAGgagTTCGACTCCGTGGAAATCTCCGGCGTGGAAGAT

CGGTTCAACGCCTCCCTGGGCACATACCACGATCTGCTGAAAATTATCAAGGACAAGGACTTCCTGGA

CAATGAGGAAAACGAGGACATTCTGGAAGATATCGTGCTGACCCTGACACTGTTTGAGGACAGAGAG

ATGATCGAGGAACGGCTGAAAACCTATGCCCACCTGTTCGACGACAAAGTGATGAAGCAGCTGAAGC

GGCGGAGATACACCGGCTGGGGCAGGCTGAGCCGGAAGCTGATCAACGGCATCCGGGACAAGCAGTC

CGGCAAGACAATCCTGGATTTCCTGAAGTCCGACGGCTTCGCCAACAGAAACTTCATGCAGCTGATCC

ACGACGACAGCCTGACCTTTAAAGAGGACATCCAGAAAGCCCAGGTGTCCGGCCAGGGCGATAGCCT

GCACGAGCACATTGCCAATCTGGCCGGCAGCCCCGCCATTAAGAAGGGCATCCTGCAGACAGTGAAG

GTGGTGGACGAGCTCGTGAAAGTGATGGGCCGGCACAAGCCCGAGAACATCGTGATCGAAATGGCCA

GAGAGAACCAGACCACCCAGAAGGGACAGAAGAACAGCCGCGAGAGAATGAAGCGGATCGAAGAGG

GCATCAAAGAGCTGGGCAGCCAGATCCTGAAAGAACACCCCGTGGAAAACACCCAGCTGCAGAACGA

GAAGCTGTACCTGTACTACCTGCAGAATGGGCGGGATATGTACGTGGACCAGGAACTGGACATCAACC

GGCTGTCCGACTACGATGTGGACCATATCGTGCCTCAGAGCTTTCTGAAGGACGACTCCATCGACAAC

AAGGTGCTGACCAGAAGCGACAAGAACCGGGGCAAGAGCGACAACGTGCCCTCCGAAGAGGTCGTGA

AGAAGATGAAGAACTACTGGCGGCAGCTGCTGAACGCCAAGCTGATTACCCAGAGAAAGTTCGACAA

TCTGACCAAGGCCGAGAGAGGCGGCCTGAGCGAACTGGATAAGGCCGGCTTCATCAAGAGACAGCTG

GTGGAAACCCGGCAGATCACAAAGCACGTGGCACAGATCCTGGACTCCCGGATGAACACTAAGTACG

ACGAGAATGACAAGCTGATCCGGGAAGTGAAAGTGATCACCCTGAAGTCCAAGCTGGTGTCCGATTTC

CGGAAGGATTTCCAGTTTTACAAAGTGCGCGAGATCAACAACTACCACCACGCCCACGACGCCTACCT

GAACGCCGTCGTGGGAACCGCCCTGATCAAAAAGTACCCTAAGCTGGAAAGCGAGTTCGTGTACGGC

GACTACAAGGTGTACGACGTGCGGAAGATGATCGCCAAGAGCGAGCAGGAAATCGGCAAGGCTACCG

CCAAGTACTTCTTCTACAGCAACATCATGAACTTTTTCAAGACCGAGATTACCCTGGCCAACGGCGAG

ATCCGGAAGCGGCCTCTGATCGAGACAAACGGCGAAACCGGGGAGATCGTGTGGGATAAGGGCCGGG

ATTTTGCCACCGTGCGGAAAGTGCTGAGCATGCCCCAAGTGAATATCGTGAAAAAGACCGAGGTGCA

GACAGGCGGCTTCAGCAAAGAGTCTATCCTGCCCAAGAGGAACAGCGATAAGCTGATCGCCAGAAAG

AAGGACTGGGACCCTAAGAAGTACGGCGGCTTCGACAGCCCCACCGTGGCCTATTCTGTGCTGGTGGT

GGCCAAAGTGGAAAAGGGCAAGTCCAAGAAACTGAAGAGTGTGAAAGAGCTGCTGGGGATCACCATC

ATGGAAAGAAGCAGCTTCGAGAAGAATCCCATCGACTTTCTGGAAGCCAAGGGCTACAAAGAAGTGA

AAAAGGACCTGATCATCAAGCTGCCTAAGTACTCCCTGTTCGAGCTGGAAAACGGCCGGAAGAGAAT

GCTGGCCTCTGCCGGCGAACTGCAGAAGGGAAACGAACTGGCCCTGCCCTCCAAATATGTGAACTTCC

TGTACCTGGCCAGCCACTATGAGAAGCTGAAGGGCTCCCCCGAGGATAATGAGCAGAAACAGCTGTTT

GTGGAACAGCACAAGCACTACCTGGACGAGATCATCGAGCAGATCAGCGAGTTCTCCAAGAGAGTGA

TCCTGGCCGACGCTAATCTGGACAAAGTGCTGTCCGCCTACAACAAGCACCGGGATAAGCCCATCAGA

GAGCAGGCCGAGAATATCATCCACCTGTTTACCCTGACCAATCTGGGAGCCCCTGCCGCCTTCAAGTA

CTTTGACACCACCATCGACCGGAAGAGGTACACCAGCACCAAAGAGGTGCTGGACGCCACCCTGATCC

ACCAGAGCATCACCGGCCTGTACGAGACACGGATCGACCTGTCTCAGCTGGGAGGCGAC (SEQ ID NO: 120)

Sp_St3 Cas9 chimera (St3 in bold)
*ATGGACTATAAGGACCACGACGGAGACTACAAGGATCATGATATTGATTACAAAGACGATGACGATAAG*<u>ATGG</u>

<u>CCCCAAAGAAGAAGCGGAAGGTCGGTATCCACGGAGTCCCAGCAGCCGACAAGAAGTACAGCATCGG</u>

CCTGGACATCGGCACCAACTCTGTGGGCTGGGCCGTGATCACCGACGAGTACAAGGTGCCCAGCAAG

AAATTCAAGGTGCTGGGCAACACCGACCGGCACAGCATCAAGAAGAACCTGATCGGAGCCCTGCTGT

```
TCGACAGCGGCGAAACAGCCGAGGCCACCCGGCTGAAGAGAACCGCCAGAAGAAGATACACCAGAC

GGAAGAACCGGATCTGCTATCTGCAAGAGATCTTCAGCAACGAGATGGCCAAGGTGGACGACAGCTT

CTTCCACAGACTGGAAGAGTCCTTCCTGGTGGAAGAGGATAAGAAGCACGAGCGGCACCCCATCTTCG

GCAACATCGTGGACGAGGTGGCCTACCACGAGAAGTACCCCACCATCTACCACCTGAGAAAGAAACT

GGTGGACAGCACCGACAAGGCCGACCTGCGGCTGATCTATCTGGCCCTGGCCCACATGATCAAGTTCC

GGGGCCACTTCCTGATCGAGGGCGACCTGAACCCCGACAACAGCGACGTGGACAAGCTGTTCATCCAG

CTGGTGCAGACCTACAACCAGCTGTTCGAGGAAAACCCCATCAACGCCAGCGGCGTGGACGCCAAGG

CCATCCTGTCTGCCAGACTGAGCAAGAGCAGACGGCTGGAAAATCTGATCGCCCAGCTGCCCGGCGAG

AAGAAGAATGGCCTGTTCGGAAACCTGATTGCCCTGAGCCTGGGCCTGACCCCCAACTTCAAGAGCAA

CTTCGACCTGGCCGAGGATGCCAAACTGCAGCTGAGCAAGGACACCTACGACGACGACCTGGACAAC

CTGCTGGCCCAGATCGGCGACCAGTACGCCGACCTGTTTCTGGCCGCCAAGAACCTGTCCGACGCCAT

CCTGCTGAGCGACATCCTGAGAGTGAACACCGAGATCACCAAGGCCCCCCTGAGCGCCTCTATGATCA

AGAGATACGACGAGCACCACCAGGACCTGACCCTGCTGAAAGCTCTCGTGCGGCAGCAGCTGCCTGA

GAAGTACAAAGAGATTTTCTTCGACCAGAGCAAGAACGGCTACGCCGGCTACATTGACGGCGGAGCC

AGCCAGGAAGAGTTCTACAAGTTCATCAAGCCCATCCTGGAAAAGATGGACGGCACCGAGGAACTGC

TCGTGAAGCTGAACAGAGAGGACCTGCTGCGGAAGCAGCGGACCTTCGACAACGGCAGCATCCCCCA

CCAGATCCACCTGGGAGAGCTGCACGCCATTCTGCGGCGGCAGGAAGATTTTTACCCATTCCTGAAGG

ACAACCGGGAAAAGATCGAGAAGATCCTGACCTTCCGCATCCCCTACTACGTGGGCCCTCTGGCCAGG

GGAAACAGCAGATTCGCCTGGATGACCAGAAAGAGCGAGGAAACCATCACCCCCTGGAACTTCGAGG

AAGTGGTGGACAAGGGCGCTTCCGCCCAGAGCTTCATCGAGCGGATGACCAACTTCGATAAGAACCTG

CCCAACGAGAAGGTGCTGCCCAAGCACAGCCTGCTGTACGAGTACTTCACCGTGTATAACGAGCTGAC

CAAAGTGAAATACGTGACCGAGGGAATGAGAAAGCCCGCCTTCCTGAGCGGCGAGCAGAAAAAGGCC

ATCGTGGACCTGCTGTTCAAGACCAACCGGAAAGTGACCGTGAAGCAGCTGAAAGAGGACTACTTCA

AGAAAATCGAGTGCTTCGACTCCGTGGAAATCTCCGGCGTGGAAGATCGGTTCAACGCCTCCCTGGGC

ACATACCACGATCTGCTGAAAATTATCAAGGACAAGGACTTCCTGGACAATGAGGAAAACGAGGACA

TTCTGGAAGATATCGTGCTGACCCTGACACTGTTTGAGGACAGAGAGATGATCGAGGAACGGCTGAAA

ACCTATGCCCACCTGTTCGACGACAAAGTGATGAAGCAGCTGAAGCGGCGGAGATACACCGGCTGGG

GCAGGCTGAGCCGGAAGCTGATCAACGGCATCCGGGACAAGCAGTCCGGCAAGACAATCCTGGATTT

CCTGAAGTCCGACGGCTTCGCCAACAGAAACTTCATGCAGCTGATCCACGACGACAGCCTGACCTTTA

AAGAGGACATCCAGAAAGCCCAGGTGTCCGGCCAGGGCGATAGCCTGCACGAGCACATTGCCAATCT

GGCCGGCAGCCCCGCCATTAAGAAGGGCATCCTGCAGACAGTGAAGGTGGTGGACGAGCTCGTGAAA

GTGATGGGCCGGCACAAGCCCGAGAACATCGTGATCGAAATGGCCAGAGAGAACCAGACCACCCAGA

AGGGACAGAAGAACAGCCGCGAGAGAATGAAGCGGATCGAAGAGGGCATCAAAGAGCTGGGCAGCC

AGATCCTGAAAGAACACCCCGTGGAAAACACCCAGCTGCAGAACGAGAAGCTGTACCTGTACTACCT

GCAGAATGGGCGGGATATGTACGTGGACCAGGAACTGGACATCAACCGGCTGTCCGACTACGATGTG

GACCATATCGTGCCTCAGAGCTTTCTGAAGGACGACTCCATCGACAACAAGGTGCTGACCAGAAGCGA

CAAGAACCGGGGCAAGAGCGACAACGTGCCCTCCGAAGAGGTCGTGAAGAAGATGAAGAACTACTGG

CGGCAGCTGCTGAACGCCAAGCTGATTACCCAGAGAAAGTTCGACAATCTGACCAAGGCCGAGAGAG

GCGGCCTGAGCGAACTGGATAAGGCCGGCTTCATCAAGAGACAGCTGGTGGAAACCCGGCAGATCAC
```

-continued

```
AAAGCACGTGGCACAGATCCTGGACTCCCGGATGAACACTAAGTACGACGAGAATGACAAGCTGATC

CGGGAAGTGAAAGTGATCACCCTGAAGTCCAAGCTGGTGTCCGATTTCCGGAAGGATTTCCAGTTTTA

CAAAGTGCGCGAGATCAACAACTACCACCACGCCCACGACGCCTACCTGAACGCCGTCGTGGGAACC

GCCCTGATCAAAAAGTACCCTAAGCTGGAAAGCGAGTTCGTGTACGGCGACTACAAGGTGTACGACGT

GCGGAAGATGATCGCCAAGAGCGAGCAGGAAATCGGCAAGGCTACCGCCAAGTACTTCTTCTACAGC

AACATCATGAACTTTTTCAAGACCGAGATTACCCTGGCCAACGGCGAGATCCGGAAGCGGCCTCTGAT

CGAGACAAACGGCGAAACCGGGGAGATCGTGTGGGATAAGGGCCGGGATTTTGCCACCGTGCGGAAA

GTGCTGAGCATGCCCCAAGTGAATATCGTGAAAAAGACCGTGGAAGAACAGAACCACGGCCTGGAT

CGGGGCAAGCCCAAGGGCCTGTTCAACGCCAACCTGTCCAGCAAGCCTAAGCCCAACTCCAACG

AGAATCTCGTGGGGGCCAAAGAGTACCTGGACCCTAAGAAGTACGGGTACGGCGGATACGCCG

GCATCTCCAATAGCTTCACCGTGCTCGTGAAGGGCACAATCGAGAAGGGCGCTAAGAAAAAGAT

CACAAACGTGCTGGAATTTCAGGGGATCTCTATCCTGGACCGGATCAACTACCGGAAGGATAAG

CTGAACTTTCTGCTGGAAAAAGGCTACAAGGACATTGAGCTGATTATCGAGCTGCCTAAGTACT

CCCTGTTCGAACTGAGCGACGGCTCCAGACGGATGCTGGCCTCCATCCTGTCCACCAACAACAA

GCGGGGCGAGATCCACAAGGGAAACCAGATCTTCCTGAGCCAGAAATTTGTGAAACTGCTGTAC

CACGCCAAGCGGATCTCCAACACCATCAATGAGAACCACCGGAAATACGTGGAAAACCACAAGA

AAGAGTTTGAGGAACTGTTCTACTACATCCTGGAGTTCAACGAGAACTATGTGGGAGCCAAGAA

GAACGGCAAACTGCTGAACTCCGCCTTCCAGAGCTGGCAGAACCACAGCATCGACGAGCTGTGC

AGCTCCTTCATCGGCCCTACCGGCAGCGAGCGGAAGGGACTGTTTGAGCTGACCTCCAGAGGCT

CTGCCGCCGACTTTGAGTTCCTGGGAGTGAAGATCCCCCGGTACAGAGACTACACCCCCTCTAG

TCTGCTGAAGGACGCCACCCTGATCCACCAGAGCGTGACCGGCCTGTACGAAACCCGGATCGAC

CTGGCTAAGCTGGGCGAGGGAAAAAGGCCGGCGGCCACGAAAAAGGCCGGCCAGGCAAAAAAGAA

AAAG (SEQ ID NO: 121)

St3_Sp Cas9 chimera (St3 in bold)
ATGGCCCCAAAGAAGAAGCGGAAGGTCGGTATCCACGGAGTCCCAGCAGCCatgACCAAGCCCTACA

GCATCGGCCTGGACATCGGCACCAATAGCGTGGGCTGGGCCGTGACCACCGACAACTACAAGG

TGCCCAGCAAGAAAATGAAGGTGCTGGGCAACACCTCCAAGAAGTACATCAAGAAAAACCTGCT

GGGCGTGCTGCTGTTCGACAGCGGCATTACAGCCGAGGGCAGACGGCTGAAGAGAACCGCCAG

ACGGCGGTACACCCGGCGGAGAAACAGAATCCTGTATCTGCAAGAGATCTTCAGCACCGAGATG

GCTACCCTGGACGACGCCTTCTTCCAGCGGCTGGACGACAGCTTCCTGGTGCCCGACGACAAGC

GGGACAGCAAGTACCCCATCTTCGGCAACCTGGTGGAAGAGAAGGCCTACCACGACGAGTTCCC

CACCATCTACCACCTGAGAAAGTACCTGGCCGACAGCACCAAGAAGGCCGACCTGAGACTGGTG

TATCTGGCCCTGGCCCACATGATCAAGTACCGGGGCCACTTCCTGATCGAGGGCGAGTTCAACA

GCAAGAACAACGACATCCAGAAGAACTTCCAGGACTTCCTGGACACCTACAACGCCATCTTCGA

GAGCGACCTGTCCCTGGAAAACAGCAAGCAGCTGGAAGAGATCGTGAAGGACAAGATCAGCAA

GCTGGAAAAGAAGGACCGCATCCTGAAGCTGTTCCCCGGCGAGAAGAACAGCGGAATCTTCAGC

GAGTTTCTGAAGCTGATCGTGGGCAACCAGGCCGACTTCAGAAAGTGCTTCAACCTGGACGAGA

AAGCCAGCCTGCACTTCAGCAAAGAGAGCTACGACGAGGACCTGGAAACCCTGCTGGGATATAT

CGGCGACGACTACAGCGACGTGTTCCTGAAGGCCAAGAAGCTGTACGACGCTATCCTGCTGAGC

GGCTTCCTGACCGTGACCGACAACGAGACAGAGGCCCCACTGAGCAGCGCCATGATTAAGCGGT
```

-continued

```
ACAACGAGCACAAAGAGGATCTGGCTCTGCTGAAAGAGTACATCCGGAACATCAGCCTGAAAAC

CTACAATGAGGTGTTCAAGGACGACACCAAGAACGGCTACGCCGGCTACATCGACGGCAAGACC

AACCAGGAAGAGGAAGATTTCTATGTGTACCTGAAGAAGCTGCTGGCCGAGTTCGAGGGGCC

GACTACTTTCTGGAAAAAATCGACCGCGAGGATTTCCTGCGGAAGCAGCGGACCTTCGACAACG

GCAGCATCCCCTACCAGATCCATCTGCAGGAAATGCGGGCCATCCTGGACAAGCAGGCCAAGTT

CTACCCATTCCTGGCCAAGAACAAAGAGCGGATCGAGAAGATCCTGACCTTCCGCATCCCTTAC

TACGTGGGCCCCCTGGCCAGAGGCAACAGCGATTTTGCCTGGTCCATCCGGAAGCGCAATGAGA

AGATCACCCCCTGGAACTTCGAGGACGTGATCGACAAAGAGTCCAGCGCCGAGGCCTTCATCAA

CCGGATGACCAGCTTCGACCTGTACCTGCCCGAGGAAAAGGTGCTGCCCAAGCACAGCCTGCTG

TACGAGACATTCAATGTGTATAACGAGCTGACCAAAGTGCGGTTTATCGCCGAGTCTATGCGGG

ACTACCAGTTCCTGGACTCCAAGCAGAAAAAGGACATCGTGCGGCTGTACTTCAAGGACAAGCG

GAAAGTGACCGATAAGGACATCATCGAGTACCTGCACGCCATCTACGGCTACGATGGCATCGAG

CTGAAGGGCATCGAGAAGCAGTTCAACTCCAGCCTGAGCACATACCACGACCTGCTGAACATTA

TCAACGACAAAGAATTTCTGGACGACTCCAGCAACGAGGCCATCATCGAAGAGATCATCCACAC

CCTGACCATCTTTGAGGACCGCGAGATGATCAAGCAGCGGCTGAGCAAGTTCGAGAACATCTTC

GACAAGAGCGTGCTGAAAAAGCTGAGCAGACGGCACTACACCGGCTGGGGCAAGCTGAGCGCC

AAGCTGATCAACGGCATCCGGGACGAGAAGTCCGGCAACACAATCCTGGACTACCTGATCGACG

ACGGCATCAGCAACCGGAACTTCATGCAGCTGATCCACGACGACGCCCTGAGCTTCAAGAAGAA

GATCCAGAAGGCCCAGATCATCGGGGACGAGGACAAGGGCAACATCAAAGAAGTCGTGAAGTC

CCTGCCCGGCAGCCCCGCCATCAAGAAGGGAATCCTGCAGAGCATCAAGATCGTGGACGAGCTC

GTGAAAGTGATGGGCGGCAGAAAGCCCGAGAGCATCGTGGTGGTGGTGGAAATGGCTAGAGAG

AACCAGTACACCAATCAGGGCAAGAGCAACAGCCAGCAGAGACTGAAGAGACTGGAAAAGTCC

CTGAAAGAGCTGGGCAGCAAGATTCTGAAAGAGAATATCCCTGCCAAGCTGTCCAAGATCGACA

ACAACGCCCTGCAGAACGACCGGCTGTACCTGTACTACCTGCAGAATGGCAAGGACATGTATAC

AGGCGACGACCTGGATATCGACCGCCTGAGCAACTACGACATCGACCATATTATCCCCCAGGCC

TTCCTGAAAGACAACAGCATTGACAACAAAGTGCTGGTGTCCTCCGCCAGCAACCGCGGCAAGT

CCGATGATGTGCCCAGCCTGGAAGTCGTGAAAAAGAGAAAGACCTTCTGGTATCAGCTGCTGAA

AAGCAAGCTGATTAGCCAGAGGAAGTTCGACAACCTGACCAAGGCCGAGAGAGGCGGCCTGAG

CCCTGAAGATAAGGCCGGCTTCATCCAGAGACAGCTGGTGGAAACCCGGCAGATCACCAAGCAC

GTGGCCAGACTGCTGGATGAGAAGTTTAACAACAAGAAGGACGAGAACAACCGGGCCGTGCGG

ACCGTGAAGATCATCACCCTGAAGTCCACCCTGGTGTCCCAGTTCCGGAAGGACTTCGAGCTGT

ATAAAGTGCGCGAGATCAATGACTTTCACCACGCCCACGACGCCTACCTGAATGCCGTGGTGGC

TTCCGCCCTGCTGAAGAAGTACCCTAAGCTGGAACCCGAGTTCGTGTACGGCGACTACCCCAAG

TACAACTCCTTCAGAGAGCGGAAGTCCGCCACCGAGAAGGTGTACTTCTACTCCAACATCATGA

ATATCTTTAAGAAGTCCATCTCCCTGGCCGATGGCAGAGTGATCGAGCGGCCCCTGATCGAAGT

GAACGAAGAGCAGGCGAGAGCGTGTGGAACAAAGAAAGCGACCTGGCCACCGTGCGGCGGGT

GCTGAGTTATCCTCAAGTGAATGTCGTGAAGAAG ACCGAGGTGCAGACAGGCGGCTTCAGCAAAG

AGTCTATCCTGCCCAAGAGGAACAGCGATAAGCTGATCGCCAGAAAGAAGGACTGGGACCCTAAGAA

GTACGGCGGCTTCGACAGCCCCACCGTGGCCTATTCTGTGCTGGTGGTGGCCAAAGTGGAAAAGGGCA

AGTCCAAGAAACTGAAGAGTGTGAAAGAGCTGCTGGGGATCACCATCATGGAAAGAAGCAGCTTCGA
```

GAAGAATCCCATCGACTTTCTGGAAGCCAAGGGCTACAAAGAAGTGAAAAAGGACCTGATCATCAAG

CTGCCTAAGTACTCCCTGTTCGAGCTGGAAAACGGCCGGAAGAGAATGCTGGCCTCTGCCGGCGAACT

GCAGAAGGGAAACGAACTGGCCCTGCCCTCCAAATATGTGAACTTCCTGTACCTGGCCAGCCACTATG

AGAAGCTGAAGGGCTCCCCCGAGGATAATGAGCAGAAACAGCTGTTTGTGGAACAGCACAAGCACTA

CCTGGACGAGATCATCGAGCAGATCAGCGAGTTCTCCAAGAGAGTGATCCTGGCCGACGCTAATCTGG

ACAAAGTGCTGTCCGCCTACAACAAGCACCGGGATAAGCCCATCAGAGAGCAGGCCGAGAATATCAT

CCACCTGTTTACCCTGACCAATCTGGGAGCCCCTGCCGCCTTCAAGTACTTTGACACCACCATCGACCG

GAAGAGGTACACCAGCACCAAAGAGGTGCTGGACGCCACCCTGATCCACCAGAGCATCACCGGCCTG

TACGAGACACGGATCGACCTGTCTCAGCTGGGAGGCGAC<u>AAAAGGCCGGCGGCCACGAAAAAGGCCG</u>

<u>GCCAGGCAAAAAGAAAAAG</u> (SEQ ID NO: 122)

SpCas9 nickases
Mutated residues (changed to GCC) bolded in order: D10, E762, N863, H983, D986
*ATGGACTATAAGGACCACGACGGAGACTACAAGGATCATGATATTGATTACAAAGACGATGACGATAAG*<u>ATGGCCCCAAGAAGAAGCG</u>

<u>GAAGGTCGGTATCCACGGAGTCCCAGCAGCC</u>GACAAGAAGTACAGCATCGGCCTGGACATCGGCACCAACTCTGTGGGCTGGGC

CGTGATCACCGACGAGTACAAGGTGCCCAGCAAGAAATTCAAGGTGCTGGGCAACACCGACCGGCACAGCATCAAGAAGAACCT

GATCGGAGCCCTGCTGTTCGACAGCGGCGAAACAGCCGAGGCCACCCGGCTGAAGAGAACCGCCAGAAGAAGATACACCAGACG

GAAGAACCGGATCTGCTATCTGCAAGAGATCTTCAGCAACGAGATGGCCAAGGTGGACGACAGCTTCTTCCACAGACTGGAAGA

GTCCTTCCTGGTGGAAGAGGATAAGAAGCACGAGCGGCACCCCATCTTCGGCAACATCGTGGACGAGGTGGCCTACCACGAGAA

GTACCCCACCATCTACCACCTGAGAAAGAAACTGGTGGACAGCACCGACAAGGCCGACCTGCGGCTGATCTATCTGGCCCTGGCC

CACATGATCAAGTTCCGGGGCCACTTCCTGATCGAGGGCGACCTGAACCCCGACAACAGCGACGTGGACAAGCTGTTCATCCAGC

TGGTGCAGACCTACAACCAGCTGTTCGAGGAAAACCCCATCAACGCCAGCGGCGTGGACGCCAAGGCCATCCTGTCTGCCAGACT

GAGCAAGAGCAGACGGCTGGAAAATCTGATCGCCCAGCTGCCCGGCGAGAAGAAGAATGGCCTGTTCGGCAACCTGATTGCCCT

GAGCCTGGGCCTGACCCCCAACTTCAAGAGCAACTTCGACCTGGCCGAGGATGCCAAACTGCAGCTGAGCAAGGACACCTACGA

CGACGACCTGGACAACCTGCTGGCCCAGATCGGCGACCAGTACGCCGACCTGTTTCTGGCCGCCAAGAACCTGTCCGACGCCATC

CTGCTGAGCGACATCCTGAGAGTGAACACCGAGATCACCAAGGCCCCCCTGAGCGCCTCTATGATCAAGAGATACGACGAGCAC

CACCAGGACCTGACCCTGCTGAAAGCTCTCGTGCGGCAGCAGCTGCCTGAGAAGTACAAAGAGATTTTCTTCGACCAGAGCAAGA

ACGGCTACGCCGGCTACATTGACGGCGGAGCCAGCCAGGAAGAGTTCTACAAGTTCATCAAGCCCATCCTGGAAAAGATGGACG

GCACCGAGGAACTGCTCGTGAAGCTGAACAGAGAGGACCTGCTGCGGAAGCAGCGGACCTTCGACAACGGCAGCATCCCCCACC

AGATCCACCTGGGAGAGCTGCACGCCATTCTGCGGCGGCAGGAAGATTTTTACCCATTCCTGAAGGACAACCGGGAAAAGATCG

AGAAGATCCTGACCTTCCGCATCCCCTACTACGTGGGCCCTCTGGCCAGGGGAAACAGCAGATTCGCCTGGATGACCAGAAAGAG

CGAGGAAACCATCACCCCCTGGAACTTCGAGGAAGTGGTGGACAAGGGCGCTTCCGCCCAGAGCTTCATCGAGCGGATGACCAA

CTTCGATAAGAACCTGCCCAACGAGAAGGTGCTGCCCAAGCACAGCCTGCTGTACGAGTACTTCACCGTGTATAACGAGCTGACC

AAAGTGAAATACGTGACCGAGGGAATGAGAAAGCCCGCCTTCCTGAGCGGCGAGCAGAAAAAGGCCATCGTGGACCTGCTGTTC

AAGACCAACCGGAAAGTGACCGTGAAGCAGCTGAAAGAGGACTACTTCAAGAAAATCGAGTGCTTCGACTCCGTGGAAATCTCC

GGCGTGGAAGATCGGTTCAACGCCTCCCTGGGCACATACCACGATCTGCTGAAAATTATCAAGGACAAGGACTTCCTGGACAATG

AGGAAAACGAGGACATTCTGGAAGATATCGTGCTGACCCTGACACTGTTTGAGGACAGAGAGATGATCGAGGAACGGCTGAAAA

CCTATGCCCACCTGTTCGACGACAAAGTGATGAAGCAGCTGAAGCGGCGGAGATACACCGGCTGGGGCAGGCTGAGCCGGAAGC

TGATCAACGGCATCCGGGACAAGCAGTCCGGCAAGACAATCCTGGATTTCCTGAAGTCCGACGGCTTCGCCAACAGAAACTTCAT

GCAGCTGATCCACGACGACAGCCTGACCTTTAAGGAGGACATCCAGAAAGCCCAGGTGTCCGGCCAGGGCGATAGCCTGCACGA

GCACATTGCCAATCTGGCCGGCAGCCCCGCCATTAAGAAGGGCATCCTGCAGACAGTGAAGGTGGTGGACGAGCTCGTGAAAGT

```
GATGGGCCGGCACAAGCCCGAGAACATCGTGATCGAAATGGCCAGAGAGAACCAGACCACCCAGAAGGGACAGAAGAACAGCC

GCGAGAGAATGAAGCGGATCGAAGAGGGCATCAAAGAGCTGGGCAGCCAGATCCTGAAAGAACACCCCGTGGAAAACACCCAG

CTGCAGAACGAGAAGCTGTACCTGTACTACCTGCAGAATGGGCGGGATATGTACGTGGACCAGGAACTGGACATCAACCGGCTGT

CCGACTACGATGTGGACCATATCGTGCCTCAGAGCTTTCTGAAGGACGACTCCATCGACAACAAGGTGCTGACCAGAAGCGACAA

GAACCGGGGCAAGAGCGACAACGTGCCCTCCGAAGAGGTCGTGAAGAAGATGAAGAACTACTGGCGGCAGCTGCTGAACGCCA

AGCTGATTACCCAGAGAAAGTTCGACAATCTGACCAAGGCCGAGAGAGGCGGCCTGAGCGAACTGGATAAGGCCGGCTTCATCA

AGAGACAGCTGGTGGAAACCCGGCAGATCACAAAGCACGTGGCACAGATCCTGGACTCCCGGATGAACACTAAGTACGACGAGA

ATGACAAGCTGATCCGGGAAGTGAAAGTGATCACCCTGAAGTCCAAGCTGGTGTCCGATTTCCGGAAGGATTTCCAGTTTTACAA

AGTGCGCGAGATCAACAACTACCACCACGCCCACGACGCCTACCTGAACGCCGTCGTGGGAACCGCCCTGATCAAAAGTACCC

TAAGCTGGAAAGCGAGTTCGTGTACGGCGACTACAAGGTGTACGACGTGCGGAAGATGATCGCCAAGAGCGAGCAGGAAATCGG

CAAGGCTACCGCCAAGTACTTCTTCTACAGCAACATCATGAACTTTTTCAAGACCGAGATTACCCTGGCCAACGGCGAGATCCGG

AAGCGGCCTCTGATCGAGACAAACGGCGAAACCGGGGAGATCGTGTGGGATAAGGGCCGGGATTTTGCCACCGTGCGGAAAGTG

CTGAGCATGCCCCAAGTGAATATCGTGAAAAAGACCGAGGTGCAGACAGGCGGCTTCAGCAAAGAGTCTATCCTGCCCAAGAGG

AACAGCGATAAGCTGATCGCCAGAAAGAAGGACTGGGACCCTAAGAAGTACGGCGGCTTCGACAGCCCCACCGTGGCCTATTCT

GTGCTGGTGGTGGCCAAAGTGGAAAAGGGCAAGTCCAAGAAACTGAAGAGTGTGAAAGAGCTGCTGGGGATCACCATCATGGAA

AGAAGCAGCTTCGAGAAGAATCCCATCGACTTTCTGGAAGCCAAGGGCTACAAAGAAGTGAAAAAGGACCTGATCATCAAGCTG

CCTAAGTACTCCCTGTTCGAGCTGGAAAACGGCCGGAAGAGAATGCTGGCCTCTGCCGGCGAACTGCAGAAGGGAAACGAACTG

GCCCTGCCCTCCAAATATGTGAACTTCCTGTACCTGGCCAGCCACTATGAGAAGCTGAAGGGCTCCCCCGAGGATAATGAGCAGA

AACAGCTGTTTGTGGAACAGCACAAGCACTACCTGGACGAGATCATCGAGCAGATCAGCGAGTTCTCCAAGAGAGTGATCCTGGC

CGACGCTAATCTGGACAAAGTGCTGTCCGCCTACAACAAGCACCGGGATAAGCCCATCAGAGAGCAGGCCGAGAATATCATCCA

CCTGTTTACCCTGACCAATCTGGGAGCCCCTGCCGCCTTCAAGTACTTTGACACCACCATCGACCGGAAGAGGTACACCAGCACC

AAAGAGGTGCTGGACGCCACCCTGATCCACCAGAGCATCACCGGCCTGTACGAGACACGGATCGACCTGTCTCAGCTGGGAGGC

GACAAAAGGCCGGCGGCCACGAAAAAGGCCGGCCAGGCAAAAAAGAAAAAG (SEQ ID NO: 123)
SpCas9 point mutants
Mutated residues (changed to GCC) bolded in order: R63A, R66A, R69A, R70A, R74A, R75A,
R78A, K163A, R165A, K510A
ATGGACTATAAGGACCACGACGGAGACTACAAGGATCATGATATTGATTACAAAGACGATGACGATAAGATGGCCCCAAGAAGAAGCG GAAGGTCGGTATCCACGGAGTCCCAGCAGCCGACAAGAAGTACAGCATCGGCCTGGACATCGGCACCAACTCTGTGGGCTGGGC CGTGATCACCGACGAGTACAAGGTGCCCAGCAAGAAATTCAAGGTGCTGGGCAACACCGACCGGCACAGCATCAAGAAGAACCT GATCGGAGCCCTGCTGTTCGACAGCGGCGAAACAGCCGAGGCCACCCGGCTGAAGAGAACCGCCAGAAGAAGATACACCAGAC GGAAGAACCGGATCTGCTATCTGCAAGAGATCTTCAGCAACGAGATGGCCAAGGTGGACGACAGCTTCTTCCACAGACTGGAAG AGTCCTTCCTGGTGGAAGAGGATAAGAAGCACGAGCGGCACCCCATCTTCGGCAACATCGTGGACGAGGTGGCCTACCACGAGA AGTACCCCACCATCTACCACCTGAGAAAGAAACTGGTGGACAGCACCGACAAGGCCGACCTGCGGCTGATCTATCTGGCCCTGGC CCACATGATCAAGTTCCGGGGCCACTTCCTGATCGAGGGCGACCTGAACCCCGACAACAGCGACGTGGACAAGCTGTTCATCCA GCTGGTGCAGACCTACAACCAGCTGTTCGAGGAAAACCCCATCAACGCCAGCGGCGTGGACGCCAAGGCCATCCTGTCTGCCAGA CTGAGCAAGAGCAGACGGCTGGAAAATCTGATCGCCCAGCTGCCCGGCGAGAAGAAGAATGGCCTGTTCGGCAACCTGATTGCC CTGAGCCTGGGCCTGACCCCCAACTTCAAGAGCAACTTCGACCTGGCCGAGGATGCCAAACTGCAGCTGAGCAAGGACACCTACG ACGACGACCTGGACAACCTGCTGGCCCAGATCGGCGACCAGTACGCCGACCTGTTTCTGGCCGCCAAGAACCTGTCCGACGCCAT CCTGCTGAGCGACATCCTGAGAGTGAACACCGAGATCACCAAGGCCCCCCTGAGCGCCTCTATGATCAAGAGATACGACGAGCA CCACCAGGACCTGACCCTGCTGAAAGCTCTCGTGCGGCAGCAGCTGCCTGAGAAGTACAAAGAGATTTTCTTCGACCAGAGCAAG AACGGCTACGCCGGCTACATTGACGGCGGAGCCAGCCAGGAAGAGTTCTACAAGTTCATCAAGCCCATCCTGGAAAAGATGGAC
```

```
GGCACCGAGGAACTGCTCGTGAAGCTGAACAGAGAGGACCTGCTGCGGAAGCAGCGGACCTTCGACAACGGCAGCATCCCCCAC
CAGATCCACCTGGGAGAGCTGCACGCCATTCTGCGGCGGCAGGAAGATTTTTACCCATTCCTGAAGGACAACCGGGAAAGATCG
AGAAGATCCTGACCTTCCGCATCCCCTACTACGTGGGCCCTCTGGCCAGGGGAAACAGCAGATTCGCCTGGATGACCAGAAAGAG
CGAGGAAACCATCACCCCCTGGAACTTCGAGGAAGTGGTGGACAAGGGCGCTTCCGCCCAGAGCTTCATCGAGCGGATGACCAA
CTTCGATAAGAACCTGCCCAACGAGAAGGTGCTGCCCAAGCACAGCCTGCTGTACGAGTACTTCACCGTGTATAACGAGCTGACC
AAAGTGAAATACGTGACCGAGGGAATGAGAAAGCCCGCCTTCCTGAGCGGCGAGCAGAAAAAGGCCATCGTGGACCTGCTGTTC
AAGACCAACCGGAAAGTGACCGTGAAGCAGCTGAAAGAGGACTACTTCAAGAAAATCGAGTGCTTCGACTCCGTGGAAATCTCC
GGCGTGGAAGATCGGTTCAACGCCTCCCTGGGCACATACCACGATCTGCTGAAAATTATCAAGGACAAGGACTTCCTGGACAATG
AGGAAAACGAGGACATTCTGGAAGATATCGTGCTGACCCTGACACTGTTTGAGGACAGAGAGATGATCGAGGAACGGCTGAAAA
CCTATGCCCACCTGTTCGACGACAAAGTGATGAAGCAGCTGAAGCGGCGAGATACACCGGCTGGGGCAGGCTGAGCCGGAAGC
TGATCAACGGCATCCGGGACAAGCAGTCCGGCAAGACAATCCTGGATTTCCTGAAGTCCGACGGCTTCGCCAACAGAAACTTCAT
GCAGCTGATCCACGACGACAGCCTGACCTTTAAAGAGGACATCCAGAAAGCCCAGGTGTCCGGCCAGGGCGATAGCCTGCACGA
GCACATTGCCAATCTGGCCGGCAGCCCCGCCATTAAGAAGGGCATCCTGCAGACAGTGAAGGTGGTGGACGAGCTCGTGAAAGT
GATGGGCCGGCACAAGCCCGAGAACATCGTGATCGAAATGGCCAGAGAGAACCAGACCACCCAGAAGGGACAGAAGAACAGCC
GCGAGAGAATGAAGCGGATCGAAGAGGGCATCAAAGAGCTGGGCAGCCAGATCCTGAAAGAACACCCCGTGGAAAACACCCAG
CTGCAGAACGAGAAGCTGTACCTGTACTACCTGCAGAATGGGCGGGATATGTACGTGGACCAGGAACTGGACATCAACCGGCTGT
CCGACTACGATGTGGACCATATCGTGCCTCAGAGCTTTCTGAAGGACGACTCCATCGACAACAAGGTGCTGACCAGAAGCGACAA
GAACCGGGGCAAGAGCGACAACGTGCCCTCCGAAGAGGTCGTGAAGAAGATGAAGAACTACTGGCGGCAGCTGCTGAACGCCA
AGCTGATTACCCAGAGAAAGTTCGACAATCTGACCAAGGCCGAGAGAGGCGGCCTGAGCGAACTGGATAAGGCCGGCTTCATCA
AGAGACAGCTGGTGGAAACCCGGCAGATCACAAAGCACGTGGCACAGATCCTGGACTCCCGGATGAACACTAAGTACGACGAGA
ATGACAAGCTGATCCGGGAAGTGAAAGTGATCACCCTGAAGTCCAAGCTGGTGTCCGATTTCCGGAAGGATTTCCAGTTTTACAA
AGTGCGCGAGATCAACAACTACCACCACGCCCACGACGCCTACCTGAACGCCGTCGTGGGAACCGCCCTGATCAAAAAGTACCCT
AAGCTGGAAAGCGAGTTCGTGTACGGCGACTACAAGGTGTACGACGTGCGGAAGATGATCGCCAAGAGCGAGCAGGAAATCGGC
AAGGCTACCGCCAAGTACTTCTTCTACAGCAACATCATGAACTTTTTCAAGACCGAGATTACCCTGGCCAACGGCGAGATCCGGA
AGCGGCCTCTGATCGAGACAAACGGCGAAACCGGGGAGATCGTGTGGGATAAGGGCCGGGATTTTGCCACCGTGCGGAAAGTGC
TGAGCATGCCCCAAGTGAATATCGTGAAAAAGACCGAGGTGCAGACAGGCGGCTTCAGCAAAGAGTCTATCCTGCCCAAGAGGA
ACAGCGATAAGCTGATCGCCAGAAAGAAGGACTGGGACCCTAAGAAGTACGGCGGCTTCGACAGCCCCACCGTGGCCTATTCTG
TGCTGGTGGTGGCCAAAGTGGAAAAGGGCAAGTCCAAGAAACTGAAGAGTGTGAAAGAGCTGCTGGGGATCACCATCATGGAAA
GAAGCAGCTTCGAGAAGAATCCCATCGACTTTCTGGAAGCCAAGGGCTACAAAGAAGTGAAAAAGGACCTGATCATCAAGCTGC
CTAAGTACTCCCTGTTCGAGCTGGAAAACGGCCGGAAGAGAATGCTGGCCTCTGCCGGCGAACTGCAGAAGGGAAACGAACTGG
CCCTGCCCTCCAAATATGTGAACTTCCTGTACCTGGCCAGCCACTATGAGAAGCTGAAGGGCTCCCCCGAGGATAATGAGCAGAA
ACAGCTGTTTGTGGAACAGCACAAGCACTACCTGGACGAGATCATCGAGCAGATCAGCGAGTTCTCCAAGAGAGTGATCCTGGCC
GACGCTAATCTGGACAAAGTGCTGTCCGCCTACAACAAGCACCGGGATAAGCCCATCAGAGAGCAGGCCGAGAATATCATCCAC
CTGTTTACCCTGACCAATCTGGGAGCCCCTGCCGCCTTCAAGTACTTTGACACCACCATCGACCGGAAGAGGTACACCAGCACCA
AAGAGGTGCTGGACGCCACCCTGATCCACCAGAGCATCACCGGCCTGTACGAGACACGGATCGACCTGTCTCAGCTGGGAGGCG
ACAAAAGGCCGGCGGCCACGAAAAAGGCCGGCCAGGCAAAAAGAAAAAG (SEQ ID NO: 124)
``` sgRNA sequences:
guide sequence underlined
+83
<u>GAGUCCGAGCAGAAGAAGAAG</u>CCCCAGAGCUAGAAAUAGCAAGUUGGGGUAAGGCUAGUCCGUUAUCAACUUG

AAAAAGUGGCACCGAGUCGGUGCUUUU (SEQ ID NO: 125)

+47
GAGUCCGAGCAGAAGAAGAAGUUUUAGAGCUAGAAAUAGCAAGUUAAAAUAAGGCUAGUCCGUUUU (SEQ ID NO: 126)

+67
GAGUCCGAGCAGAAGAAGAAGUUUUAGAGCUAGAAAUAGCAAGUUAAAAUAAGGCUAGUCCGUUAUCAACUU

GAAAAAGUGUUUU (SEQ ID NO: 127)

mutate proximal crRNA:tracrRNA duplex
GAGUCCGAGCAGAAGAAGAAGCCCCAGAGCUAGAAAUAGCAAGUUGGGGUAAGGCUAGUCCGUUAUCAACUUG

AAAAAGUGGCACCGAGUCGGUGCUUUU (SEQ ID NO: 128)

truncate distal crRNA:tracrRNA duplex
GAGUCCGAGCAGAAGAAGAAGUUUUAGAGACAAGUUAAAAUAAGGCUAGUCCGUUAUCAACUUGAAAAAGUG

GCACCGAGUCGGUGCUUUU (SEQ ID NO: 129)

remove crRNA:tracrRNA duplex bulge
GAGUCCGAGCAGAAGAAGAAGUUUUAGAGCUAGAAAUAGCUUUAAAAUAAGGCUAGUCCGUUAUCAACUUGA

AAAGUGGCACCGAGUCGGUGCUUUU (SEQ ID NO: 130)

abolish stemloop 1
GAGUCCGAGCAGAAGAAGAAGUUUUAGAGCUAGAAAUAGCAAGUUAAAAUAAUUCUAGUAAGUUAUCAACUU

GAAAAAGUGGCACCGAGUCGGUGCUUUU (SEQ ID NO: 131)

mutate stemloop 1
GAGUCCGAGCAGAAGAAGAAGUUUUAGAGCUAGAAAUAGCAAGUUAAAAUAAGCCAUGUGCGUUAUCAACUU

GAAAAAGUGGCACCGAGUCGGUGCUUUU (SEQ ID NO: 132)

truncate linker
GAGUCCGAGCAGAAGAAGAAGUUUUAGAGCUAGAAAUAGCAAGUUAAAAUAAGGCUAGUCCGUAACUUGAAA

AAGUGGCACCGAGUCGGUGCUUUU (SEQ ID NO: 133)

replace stemloop 2
GAGUCCGAGCAGAAGAAGAAGUUUUAGAGCUAGAAAUAGCAAGUUAAAAUAAGGCUAGUCCGUUAUCACGCC

GAAAGGCGGGCACCGAGUCGGUGCUUUU (SEQ ID NO: 134)

lengthen stemloop 2
GAGUCCGAGCAGAAGAAGAAGUUUUAGAGCUAGAAAUAGCAAGUUAAAAUAAGGCUAGUCCGUUAUCAACUU

GAGAAAUCAAGUGGCACCGAGUCGGUGCUUUU (SEQ ID NO: 135)

mutate stemloop 3
GAGUCCGAGCAGAAGAAGAAGUUUUAGAGCUAGAAAUAGCAAGUUAAAAUAAGGCUAGUCCGUUAUCAACUU

GAAAAAGUGGCCCCGCGGCGGGGCUUUU (SEQ ID NO: 136)

lengthen stemloop 3
GAGUCCGAGCAGAAGAAGAAGUUUUAGAGCUAGAAAUAGCAAGUUAAAAUAAGGCUAGUCCGUUAUCAACUU

GAAAAAGUGGCACCGAAAGUUUCGGUGCUUUU (SEQ ID NO: 137)

reconstructed sgRNA
GAGUCCGAGCAGAAGAAGAAGCCCCAGAGCAUUAGCAAGUUGGGGUAAGCCAUGUGCGUUAUCAGGGCACCAG

CCCGGCACCGAGUCGGUGCUUUU (SEQ ID NO: 138)

G43A
GAGUCCGAGCAGAAGAAGAAGUUUUAGAGCUAGAAAUAGCAACUUAAAAUAAGGCUAGUCCGUUAUCAACUU

GAAAAAGUGGCACCGAGUCGGUGCUUUU (SEQ ID NO: 139)

U44G
GAGUCCGAGCAGAAGAAGAAGUUUUAGAGCUAGAAAUAGCAAGGUAAAAUAAGGCUAGUCCGUUAUCAACUU

GAAAAAGUGGCACCGAGUCGGUGCUUUU (SEQ ID NO: 140)

U44C
GAGUCCGAGCAGAAGAAGAAGUUUUAGAGCUAGAAAUAGCAAGCUAAAAUAAGGCUAGUCCGUUAUCAACUU

GAAAAAGUGGCACCGAGUCGGUGCUUUU (SEQ ID NO: 141)

Primers (SEQ ID NOS 142-145, respectively, in order of appearance)

| Cas9 | Target | PAM | SURVEYOR primer F | SURVEYOR PRIMER R |
|---|---|---|---|---|
| Sp | GAGTCCGAGCAGAAGAAGAA | GGG | CCATCCCCTTCTGTGAATGT | GGAGATTGGAGACACGGAGA |
| St3 | GCTCCCATCACATCAACCGG | TGGCG | same | same |

Example 13: Generation of Optimized Functional CRISPR-Cas Systems Targeting the Neurog2 Gene by Modifying sgRNA Architecture with the Insertion of MS2 Loops into Loops of the sgRNA The crystal structure information (described in U.S. provisional applications 61/915,251 filed Dec. 12, 2013, 61/930,214 filed on Jan. 22, 2014, 61/980,012 filed Apr. 15, 2014) provides structural information to modify sgRNA architecture. Applicants determined that there was potentially room for extension of both the tetraloop and loop2 of the sgRNA (without collision with the Cas9 protein). Applicants showed that insertion of MS2 loops at these positions enabled recruitment of MS2 binding proteins to these two locations, and thereby mediated locus specific recruitment of any effector fusions (such as transcriptional activator domains vp64, p65, transcriptional repressor domains SID4X, KRAB, or any epigenetic effector domains). The Examples are interesting. There is a focus on the identification of two 4nt stretches in the guides that are exposed "outside" of Cas9-guide-target DNA complex (no contact between these 4 nt stem terminations and Cas9 amino acids were identified in the crystal). One 4nt stretch falls in the tetraloop, the other 4nt stretch falls in the stem loop 2. Either or both of these 4nt stretches can be replaced by aptamer sequence. Each or both can either be replaced completely or partially, or that either or both may be retained completely and a noncoding loop can be added after the 4 nts. The aptamers is a polynucleotide and may be DNA or RNA, but RNA is preferred. The aptamer has a corresponding RNA-binding protein that recognises a specific RNA sequence. Recruitment of these effector domains to the tetraloop and loop 2 of the sgRNA potentially led to a more favorable positioning relative to the targeted DNA (compared to C-term fusions of effector domains to the Cas9 proteins or addition of Ms2 loops after loop 3 of the sgRNA).

Neuro 2a cells (Sigma-Aldrich) were grown in media containing a 1:1 ratio of OptiMEM (Life Technologies) to high-glucose DMEM with GlutaMax and sodium pyruvate (Life Technologies) supplemented with 5% HyClone heat-inactivated FBS (Thermo Scientific), 1% penicillin/streptomycin (Life Technologies), and passaged at 1:5 every 2 days. 120,000 cells were plated in each well of a 24-well plate 18-20 h before transfection. Cells were transfected with Lipofectamine transfection reagent (Life Technologies) according to the manufacturer's instructions. Plasmid DNA was used for transfection of MS2-VP64 and Cas9 constructs, while PCR product was transfected for the guide RNA expression cassette.

RNA was extracted using the RNeasy kit (Qiagen) according to manufacturer's instructions and 1 mg of RNA per sample was reverse-transcribed using qScript (Quanta Biosystems). Relative mRNA levels were measured by reverse transcription and quantitative PCR (qRT-PCR) using TaqMan probes specific for the targeted gene as well as GAPDH as an endogenous control (Life Technologies). ddCt analysis was used to obtain fold-changes relative to negative controls transfected with GFP only.

Results indicated that both insertions in the tetraloop and loop 2 are effective and that the most efficient combination uses an insertion of MS2 loops in both in the tetraloop and in loop 2 of the sgRNA in combination with a dCas9-vp64 and MS2-vp64 construct. This new activator design (illustrated in FIG. 44 and shown as red bar for the TL+L2: Ms2 guide in FIG. 45) was found to mediate much higher target gene upregulation compared to the previous design (illustrated in FIG. 43 and shown as the green bar for the regular guide in FIG. 45).

MS2 Pilot Sequences are indicated below:

Neurog2 target sequence
(SEQ ID NO: 146)
GATACGATGAAAAGAATAAGC

Tetraloop MS2 stem loop insertion sgRNA scaffold
(SEQ ID NO: 147)
NNNNNNNNNNNNNNNNNNNNNgttttagagctaggccAACATGAGGATCACCCATG TCTGCAGggcctagcaagttaaaataaggctagtccgttatcaCGCCGAAAGGCGggcaccgAGTcggtgcTTTTT Loop 2 MS2 stem loop insertion sgRNA scaffold
(SEQ ID NO: 148)
NNNNNNNNNNNNNNNNNNNNNgttttagagctaGAAAtagcaagttaaaataaggctagtccgttat caacttggccAACATGAGGATCACCCATGTCTGCAGggccaagtggcaccgAGTcggtgcTTTTT -continued Tetraloop and Loop 2 MS2 stem loop insertion sgRNA scaffold
(SEQ ID NO: 149)

NNNNNNNNNNNNNNNNNNNNNNgttttagagctaggccAACATGAGGATCACCCATG

TCTGCAGggcctagcaagttaaaataaggctagtccgttatcaacttggccAACATGAGGATCACCCATGTCTG

CAGggccaagtggcaccgAGTcggtgcTTTTT

Standard guide scaffold
(SEQ ID NO: 150)

NNNNNNNNNNNNNNNNNNNNNNgttttagagctaGAAAtagcaagttaaaataaggctagtccgttat caacttGAAAaagtggcaccgAGTcggtgcTTTTT MS2-vp64 sequence
(SEQ ID NO: 151)

ATGGCTTCAAACTTTACTCAGTTCGTGCTCGTGGACAATGGTGGGACAGG

GGATGTGACAGTGGCTCCTTCTAATTTCGCTAATGGGGTGGCAGAGTGGATCAGCTC

CAACTCACGGAGCCAGGCCTACAAGGTGACATGCAGCGTCAGGCAGTCTAGTGCCC

AGAAgAGAAAGTATACCATCAAGGTGGAGGTCCCCAAAGTGGCTACCCAGACAGTG

GGCGGAGTCGAACTGCCTGTCGCCGCTTGGAGGTCCTACCTGAACATGGAGCTCACT

ATCCCAATTTTCGCTACCAATTCTGACTGTGAACTCATCGTGAAGGCAATGCAGGGG

CTCCTCAAAGACGGTAATCCTATCCCTTCCGCCATCGCCGCTAACTCAGGTATCTACa gcgctGGAGGAGGTGGAAGCGGAGGAGGAGGAAGCGGAGGAGGAGGTAGCggacctaaga aaaagaggaaggtggcggccgctggatccGGACGGGCTGACGCATTGGACGATTTTGATCTGGATAT

GCTGGGAAGTGACGCCCTCGATGATTTTGACCTTGACATGCTTGGTTCGGATGCCCT

TGATGACTTTGACCTCGACATGCTCGGCAGTGACGCCCTTGATGATTTCGACCTGGA

CATGCTGATTAAC

Figure 46:
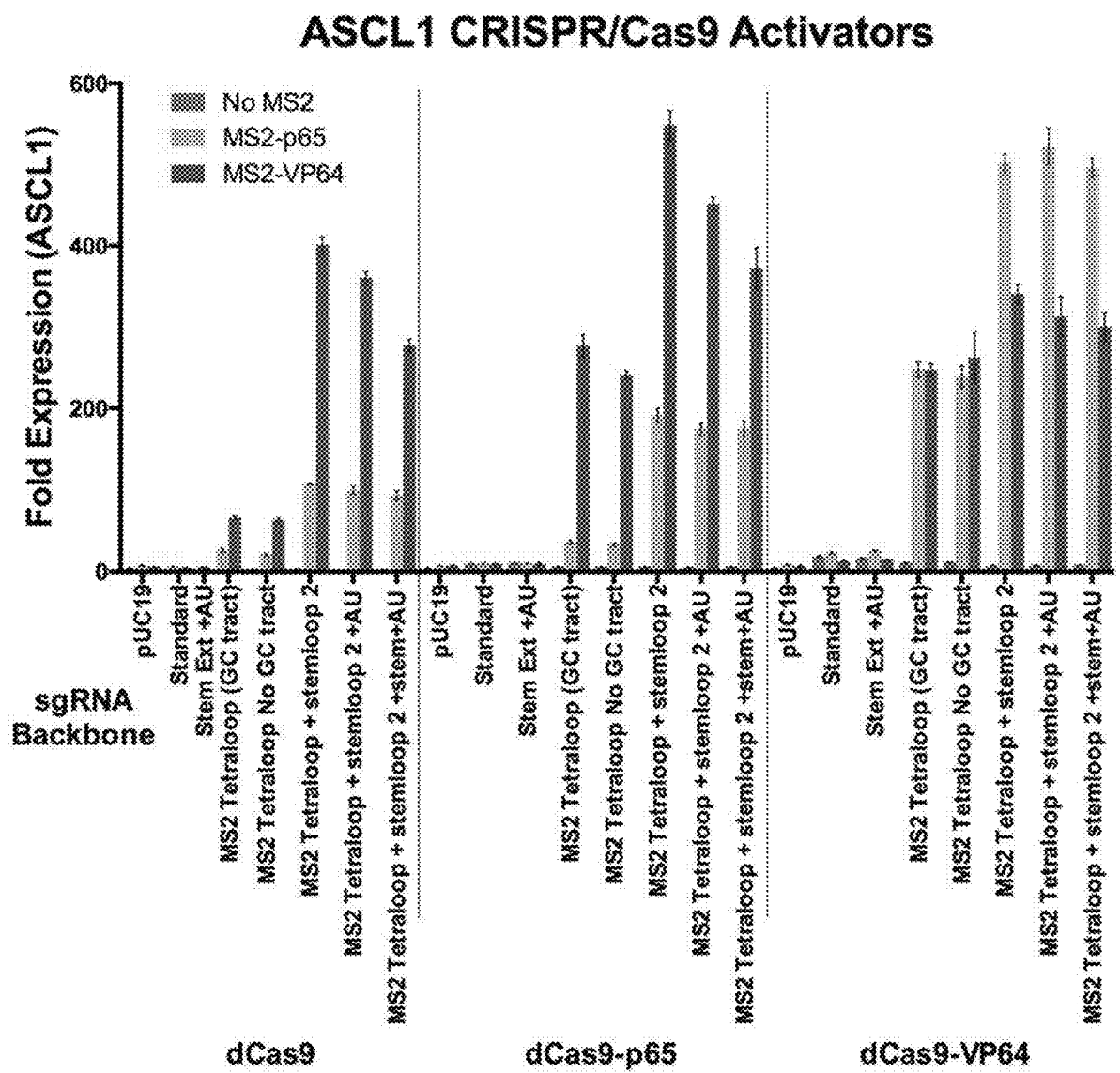
FIG. 46 shows Human ASCL1 upregulation with Cas9-MS2 activators.
Figure 47:
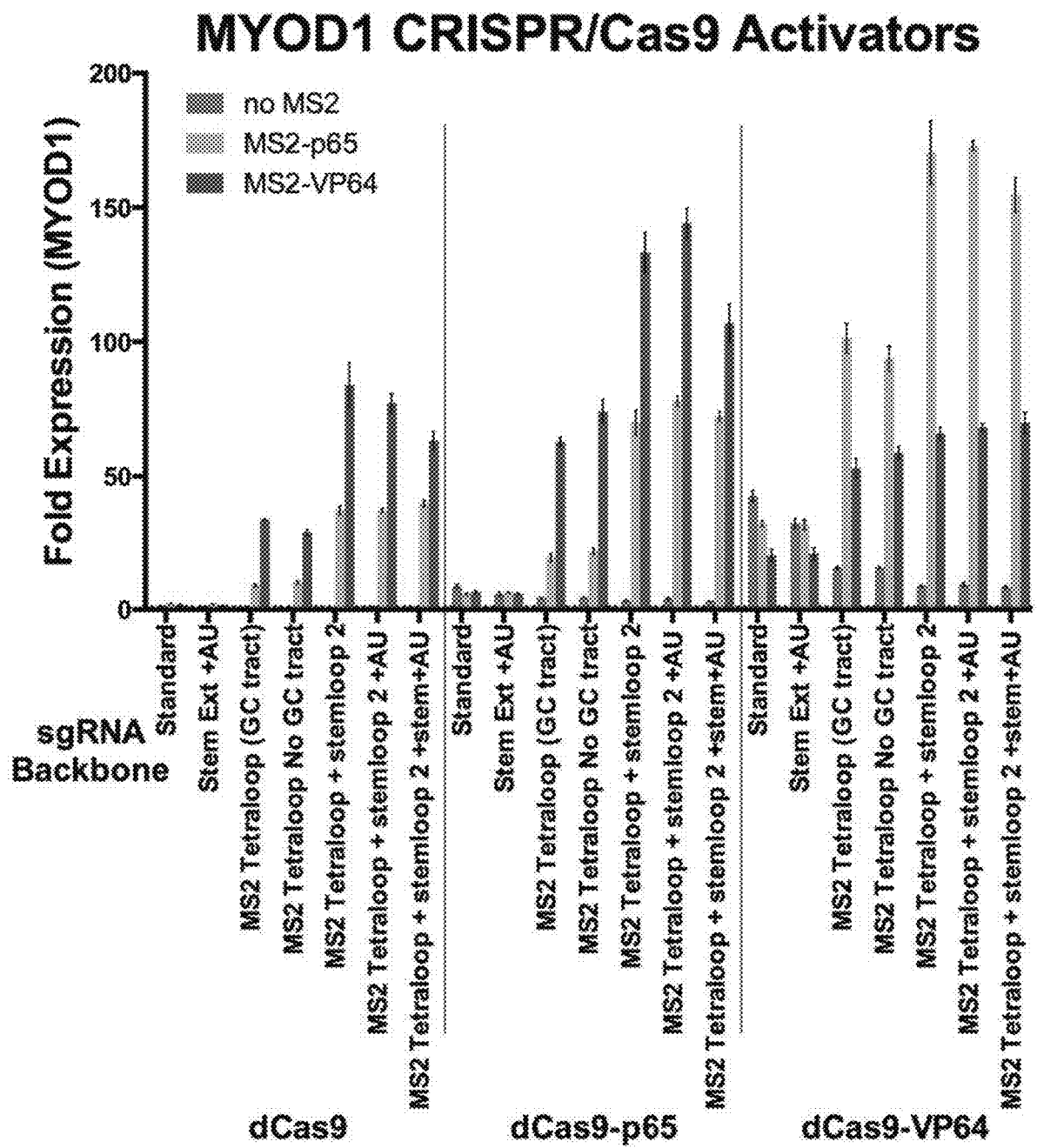
FIG. 47 shows Human MYOD1 upregulation with Cas9-MS2 activators.

Example 14: Further Optimization of Functional CRISPR-Cas Systems by Modifying sgRNA Backbone or Architecture Applicants tested the efficiency of the tetraloop and loop2 MS2 loop insertions on two additional gene targets (human ASCL1 and human MYOD1) and confirmed the increased effectiveness of sgRNA design as described in Example 13 compared to the standard C-terminal fusion of VP64 to Cas9 (See FIGS. 46 and 47). Applicants further tested the hypothesis that a combination of two different activation domains (for e.g. VP64 and P65) could lead to synergy and therefore increased efficiency of target gene upregulation compared to using the same total number of a single type of activation domain. Applicants also tested an alternative guide architecture optimized for CRISPR/Cas9 imaging in: Chen, Baohui, et al. "Dynamic Imaging of Genomic Loci in Living Human Cells by an Optimized CRISPR/Cas System." Cell 155.7 (2013): 1479-1491 in the context of gene activation.

Methods:

```
Target Sequences
ASCL1
                                    (SEQ ID NO: 152)
    GCAGCCGCTCGCTGCAGCAG MYOD1
                                    (SEQ ID NO: 153)
    GGGCCCCTGCGGCCACCCCG
```

Cell Culture and Transfection and Gene Expression Analysis

Human HEK293FT cells were maintained in high-glucose DMEM with GlutaMax and sodium pyruvate (Life Technologies) supplemented with 10% heat-inactivated characterized HyClone fetal bovine serum (Thermo Scientific) and 1% penicillin/streptomycin (Life Technologies). Cells were passaged daily at a ratio 1 to 2 or 1 to 2.5. For MS2/dCas9 activator experiments, 20,000 HEK293FT cells were plated in 100 μL of culture medium in poly-d-lysine coated 96-well plates (BD biosciences). 24 hours after plating, cells were transfected with a 1:1:1 mass ratio of:
  sgRNA backbone plasmid with gene specific targeting sequence or pUC19 control plasmid
  MS2-VP64 plasmid or MS2-p65 plasmid or pUC19 control plasmid
  dCas9 plasmid or dCas9-VP64 plasmid or dCas9-p65 plasmid or pUC19 control plasmid Total plasmid mass per well was 0.3 micrograms. Transfection was performed with 1.5 uL Lipfectamine 2000 (Life Technologies), according to the manufacturer's instructions. Culture medium was changed 5 hours after transfection. 48 hours after transfection, cell lysis and reverse transcription were performed using a Cells-to-Ct kit (Life Technologies). Gene expression levels were quantified by using Taqman qPCR probes (Life technologies) and Fast Advanced Master Mix (Life Technologies). ASCL1 and MYOD1 expression levels were calculated relative to GAPDH expression level. Fold gene expression levels were determined by comparison to samples transfected with GFP plasmid only.

The results indicate that the Applicants validated the efficiency of the tetraloop and loop2 MS2 loop insertions on two additional gene targets and confirmed the increased effectiveness of this design compared to the standard C-terminal fusion of VP64 to Cas9. Applicants further confirmed the hypothesis that a combination of two different activation domains could improve target gene activation (via synergy, e.g. by recruiting different epigenetic modulators, general transcription factors and co-activators). Applicants also determined that the alternative guide architecture optimized for CRISPR/Cas9 imaging in: Chen, Baohui, et al. "Dynamic Imaging of Genomic Loci in Living Human Cells by an Optimized CRISPR/Cas System." Cell 155.7 (2013): 1479-1491 did not exhibit any improvement over the standard architecture.

In conclusion, these experiments showed that an improved Cas9 activator architecture consists of a sgRNA with MS2 loop insertions in the tetraloop and loop 2 in combination with either MS2-VP64 and dCas9-P65 or MS2-P65 and dCas9-VP64.

MS2 sgRNA Scaffold Sequence Information

In all sequences below, NNNNNNNNNNNNNNNNNNNN represents the locus-specific targeting sequence of each sgRNA.

pSAMca006 standard sgRNA backbone (SEQ ID NO: 154)
NNNNNNNNNNNNNNNNNNNNgttttagagctaGAAAtagcaagttaaa ataaggctagtccgttatcaacttgaaaaagtggcaccgagtcggtgcTT

TTTTT

+83 nucleotide chimeric backbone used in Zhang Lab CRISPR/Cas9 publications pSAMca002 Tetraloop stem extension+AU flip sgRNA backbone (SEQ ID NO: 155)
NNNNNNNNNNNNNNNNNNNNgtttaagagctatgctgGAAAcagcatagc aagtttaaataaggctagtccgttatcaacttgaaaaagtggcaccgagt cggtgcTTTTTTT Backbone optimized for CRISPR/Cas9 imaging in:

Chen, Baohui, et al. "Dynamic Imaging of Genomic Loci in Living Human Cells by an Optimized CRISPR/Cas System." Cell 155.7 (2013): 1479-1491.

T in location +5 (5th nucleotide after target sequence) exchanged with A in location +36. Authors suggest this change should increase sgRNA concentration by removing putative U6 termination site at location +2 to +5.

TGCTG is added after location +12 of standard backbone and CAGCA is added after location +21 of standard backbone. These insertions pair with one another to created an extended stem at the base of the tetraloop. Authors suggest that this stem extension may help stabilize the sgRNA.

pSAMca009 MS2-binding loop on tetraloop and stemloop 2 sgRNA backbone (SEQ ID NO: 156)
NNNNNNNNNNNNNNNNNNNNgttttagagctaggccAACATGAGGATCA CCCATGTCTGCAGggcctagcaagttaaaataaggctagtccgttatca acttggccAACATGAGGATCACCCATGTCTGCAGggccaagtggc accgagtcggtgcTTTTTTT MS2-binding loop ggccAACATGAGGATCACCCATGTCTGCAGggcc (SEQ ID NO: 8) replaces nucleotides+13 to +16 and nucleotides+53 to +56 of the standard sgRNA backbone. The resulting structure is an sgRNA scaffold in which the tetraloop and stemloop 2 sequences have been replaced by an MS2 binding loop. The tetraloop and stemloop 2 were selected for replacement based on information obtained from the Cas9/RNA/DNA crystal structure. Specifically, the tetraloop and stemloop 2 were found to protrude from the Cas9 protein in such a way which suggested that adding an MS2 binding loop would not interfere with any Cas9 residues. Additionally, the proximity of the tetraloop and stemloop 2 sites to the DNA suggested that localization to these locations would result in a high degree of interaction between the DNA and any recruited protein, such as a transcriptional activator.

pSAMca010 MS2-binding loop on tetraloop and stemloop 2+tetraloop stem extension+AU flip sgRNA backbone (SEQ ID NO: 157)
NNNNNNNNNNNNNNNNNNNNgtttaagagctatgctgggccAACATGAGG ATCACCCATGTCTGCAGggcccagcatagcaagtttaaataaggctagtc cgttatcaacttggccAACATGAGGATCACCCATGTCTGCAGggccaagt ggcaccgagtcggtgcTTTTTTT T in location +5 of standard sgRNA backbone exchanged with A in location +36 of standard sgRNA backbone. The stem loop extension and MS2-binding loop sequence tgctgggccAACATGAGGATCACCCATGTCTGCAGggcccagca (SEQ ID NO: 158) replaces nucleotides+13 to +16 of the standard sgRNA backbone. The MS2-binding loop sequence ggccAACATGAGGATCACCCATGTCTGCAGggcc (SEQ ID NO: 8) replaces nucleotides+53 to +56 of the standard sgRNA backbone. The resulting structure combines the hypotheses described for pSAMca002 and pSAMca009.

pSAMca011 MS2-binding loop on tetraloop and stemloop 2+AU flip sgRNA backbone (SEQ ID NO: 159)
NNNNNNNNNNNNNNNNNNNNgtttaagagctaggccAACATGAGGATCAC CCATGTCTGCAGggcctagcaagtttaaataaggctagtccgttatcaac ttggccAACATGAGGATCACCCATGTCTGCAGggccaagtggcaccgagt cggtgcTTTTTTT T in location +5 of standard sgRNA backbone exchanged with A in location +36 of standard sgRNA backbone. The MS2-binding loop sequence ggccAACATGAGGATCAC-CCATGTCTGCAGggcc (SEQ ID NO: 8) replaces nucleotides+13 to +16 and nucleotides+53 to +56 of the standard sgRNA backbone. The resulting structure combines the hypothesis described for pSAMca009 with the AUflip hypothesis of pSAMca002 (removing putative U6 termination). This construct differs from pSAMca010 in that it does not include the additional tgctg tetraloop stem extension from pSAMca002, to determine whether overextending the tetraloop stem would diminish sgRNA functionality in the case of pSAMca010.

pSAMca003 MS2-binding loop on tetraloop+stemloop 2 GC tract switch sgRNA backbone (SEQ ID NO: 160)
NNNNNNNNNNNNNNNNNNNNgttttagagctaggccAACATGAGGATCAC CCATGTCTGCAGggcctagcaagttaaaataaggctagtccgttatcaCG CCgaaaGGCGggcaccgagtcggtgcTTTTTTT The MS2-binding loop sequence ggccAACATGAGGAT-CACCCATGTCTGCAGggcc (SEQ ID NO: 8) replaces nucleotides+13 to +16 of the standard sgRNA backbone. The sequence CGCC replaces nucleotides+49 to +52 of the standard sgRNA backbone. The sequence GGCG replaces nucleotides+57 to +60 of the standard sgRNA backbone. The tetraloop MS2-binding loop insertion was designed with the same rationale as described for pSAMca009 above. The CGCC and GGCG sequences replace the stem portion of stemloop 2. The increased base-pairing strength of the CGCC-GGCG stem compared to the original ACTT-AAGT stem was hypothesized to provide additional stability to the stemloop 2 structure, thereby increasing sgRNA performance or longevity.

pSAMca013 MS2-binding loop on tetraloop No stemloop 2 GC tract switch sgRNA backbone (SEQ ID NO: 161)
NNNNNNNNNNNNNNNNNNNNNgttttagagctaggccAACATGAGGATCAC CCATGTCTGCAGggcctagcaagttaaaataaggctagtccgttatcaac ttgaaaaagtggcaccgagtcggtgcTTTTTTT The MS2-binding loop sequence ggccAACATGAGGAT-CACCCATGTCTGCAGggcc (SEQ ID NO: 8) replaces nucleotides+13 to +16 of the standard sgRNA backbone. The tetraloop MS2-binding loop insertion was designed with the same rationale as described for pSAMca009 above.

pSAMca025 MS2-binding loop on tetraloop and stemloop 2+2 MS2 binding loops on 3' tail sgRNA backbone (SEQ ID NO: 162)
NNNNNNNNNNNNNNNNNNNNNgttttagagctaggccAACATGAGGATCAC CCATGTCTGCAGggcctagcaagttaaaataaggctagtccgttatcaac ttggccAACATGAGGATCACCCATGTCTGCAGggccaagtggcaccgagt cggtgcTAACATGAGGATCACCCATGTCTGCAGTGCAGGTCGACTCTAGA

AACATGAGGATCACCCATGTTTTTTTT

The sequence TAACATGAGGATCACCCATGTCT-GCAGTGCAGGTCGACTCTAGAAACATGAGGATC ACCCATGT (SEQ ID NO: 163) comprising two MS2-binding loops separated by a short linker was inserted between nucleotide +76 and +77 of the standard sgRNA backbone. We hypothesize that adding 2 additional MS2-binding loops to the 3' tail of the sgRNA will increase the activity of the MS2/CRISPR/dCas9 activator system by providing a greater number of MS2 domain binding sites and facilitating increased recruitment of activation domains.

pSAMca026 MS2-binding loop on tetraloop and stemloop 1 and stemloop 2 sgRNA backbone (SEQ ID NO: 164)
NNNNNNNNNNNNNNNNNNNNNgttttagagctaggccAACATGAGGATCAC CCATGTCTGCAGggcctagcaagttaaaataagggccAACATGAGGATC ACCCATGTCTGCAGggcctccgttatcaacttggccAACATGAGGATCAC CCATGTCTGCAGggccaagtggcaccgagtcggtgcTTTTTTT MS2-binding loop ggccAACATGAGGATCACCCAT-GTCTGCAGggcc (SEQ ID NO: 8) replaces nucleotides+13 to +16 and nucleotides+35 to +38 and nucleotides+53 to +56 of the standard sgRNA backbone. In addition to the tetraloop and stemloop 1 MS2-binding loop replacements described for pSAMca009, this structure replaces the loop of stem loop 1 with an MS2-binding loop. The exposed state of stemloop 1, as observed in the Cas9/RNA/DNA crystal structure, suggests that adding an MS2-binding loop at this location would not disrupt the Cas9/RNA/DNA interaction. Further, an MS2-binding loop inserted at this location would allow for recruitment of MS2-activator protein in a region local to the target DNA.

MS2-activator Protein Information

MS2-VP64

DNA sequence (SEQ ID NO: 165)
ATGGCTTCAAACTTTACTCAGTTCGTGCTCGTGGACAATGGTGGGACAGG

GGATGTGACAGTGGCTCCTTCTAATTTCGCTAATGGGGTGGCAGAGTGGA

TCAGCTCCAACTCACGGAGCCAGGCCTACAAGGTGACATGCAGCGTCAGG

CAGTCTAGTGCCCAGAAgAGAAAGTATACCATCAAGGTGGAGGTCCCCAA

AGTGGCTACCCAGACAGTGGGCGGAGTCGAACTGCCTGTCGCCGCTTGGA

GGTCCTACCTGAACATGGAGCTCACTATCCCAATTTTCGCTACCAATTCT

GACTGTGAACTCATCGTGAAGGCAATGCAGGGGCTCCTCAAAGACGGTAA

TCCTATCCCTTCCGCCATCGCCGCTAACTCAGGTATCTACagcgctGGAG

GAGGTGGAAGCGGAGGAGGAGGAAGCGGAGGAGGAGGTAGCGgacctaag aaaaagaggaaggtggcggccgctggatccGGACGGGCTGACGCATTGGA

CGATTTTGATCTGGATATGCTGGGAAGTGACGCCCTCGATGATTTTGACC

TTGACATGCTTGGTTCGGATGCCCTTGATGACTTTGACCTCGACATGCTC

GGCAGTGACGCCCTTGATGATTTCGACCTGGACATGCTGATTAAC

Amino Acid Sequence (SEQ ID NO: 166)
MASNFTQFVLVDNGGTGDVTVAPSNFANGVAEWISSNSRSQAYKVTCSVR

QSSAQKRKYTIKVEVPKVATQTVGGVELPVAAWRSYLNMELTIPIFATNS

DCELIVKAMQGLLKDGNPIPSAIAANSGIYSAGGGGSGGGGSGGGGSGPK

KKRKVAAAGSGRADALDDFDLDMLGSDALDDFDLDMLGSDALDDFDLDML

GSDALDDFDLDMLIN

Description

The MS2-VP64 activator protein consists of the following domains from N-term to C-term: the N55K mutant of the MS2 bacteriophage coat protein (shown to have higher binding affinity than wild type MS2 in Lim, F., M. Spingola, and D. S. Peabody. "Altering the RNA binding specificity of a translational repressor." Journal of Biological Chemistry 269.12 (1994): 9006-9010.), 3X GGGGS linker (SEQ ID NO: 9), SV40 nuclear localization signal, and VP64 activation domain. Functionally, the MS2 domain binds to its specific RNA aptamer, the 3XGGGGS linker (SEQ ID NO: 9) provides mechanical flexibility between the MS2 and VP64 domains, the SV40 nuclear localization signal facilitates transport of the protein into the nucleus, and the VP64 activation domain promotes transcriptional activation.

MS2-p65
DNA Sequence (SEQ ID NO: 167)
ATGGCTTCAAACTTTACTCAGTTCGTGCTCGTGGACAATGGTGGGACAGG

GGATGTGACAGTGGCTCCTTCTAATTTCGCTAATGGGGTGGCAGAGTGGA

TCAGCTCCAACTCACGGAGCCAGGCCTACAAGGTGACATGCAGCGTCAGG

CAGTCTAGTGCCCAGAAgAGAAAGTATACCATCAAGGTGGAGGTCCCCAA

AGTGGCTACCCAGACAGTGGGCGGAGTCGAACTGCCTGTCGCCGCTTGGA

GGTCCTACCTGAACATGGAGCTCACTATCCCAATTTTCGCTACCAATTCT

GACTGTGAACTCATCGTGAAGGCAATGCAGGGGCTCCTCAAAGACGGTAA

TCCTATCCCTTCCGCCATCGCCGCTAACTCAGGTATCTACagcgctGGAG

GAGGTGGAAGCGGAGGAGGAGGAAGCGGAGGAGGAGGTAGCGgacctaag aaaaagaggaaggtggcggccgctggatccCCTTCAGGGCAGATCAGCAA

CCAGGCCCTGGCTCTGGCCCCTAGCTCCGCTCCAGTGCTGGCCCAGACTA

TGGTGCCCTCTAGTGCTATGGTGCCTCTGGCCCAGCCACCTGCTCCAGCC

CCTGTGCTGACCCCAGGACCACCCCAGTCACTGAGCGCTCCAGTGCCCAA

GTCTACACAGGCCGGCGAGGGGACTCTGAGTGAAGCTCTGCTGCACCTGC

AGTTCGACGCTGATGAGGACCTGGGAGCTCTGCTGGGGAACAGCACCGAT

CCCGGAGTGTTCACAGATCTGGCCTCCGTGGACAACTCTGAGTTTCAGCA

GCTGCTGAATCAGGGCGTGTCCATGTCTCATAGTACAGCCGAACCAATGC

TGATGGAGTACCCCGAAGCCATTACCCGGCTGGTGACCGGCAGCCAGCGG

CCCCCCGACCCCGCTCCAACTCCCCTGGGAACCAGCGGCCTGCCTAATGG

GCTGTCCGGAGATGAAGACTTCTCAAGCATCGCTGATATGGACTTTAGTG

CCCTGCTGTCACAGATTTCCTCTAGTGGGCAG

Amino Acid Sequence (SEQ ID NO: 168)
MASNFTQFVLVDNGGTGDVTVAPSNFANGVAEWISSNSRSQAYKVTCSVR

QSSAQKRKYTIKVEVPKVATQTVGGVELPVAAWRSYLNMELTIPIFATNS

DCELIVKAMQGLLKDGNPIPSAIAANSGIYSAGGGGSGGGGSGGGGSGPK

KKRKVAAAGSPSGQISNQALALAPSSAPVLAQTMVPSSAMVPLAQPPAPA

PVLTPGPPQSLSAPVPKSTQAGEGTLSEALLHLQFDADEDLGALLGNSTD

PGVFTDLASVDNSEFQQLLNQGVSMSHSTAEPMLMEYPEAITRLVTGSQR

PPDPAPTPLGTSGLPNGLSGDEDFSSIADMDFSALLSQISSSGQ

Description

The MS2-VP64 activator protein consists of the following domains from N-term to C-term: the N55K mutant of the MS2 bacteriophage coat protein (shown to have higher binding affinity than wild type MS2 in Lim, F., M. Spingola, and D. S. Peabody. "Altering the RNA binding specificity of a translational repressor." Journal of Biological Chemistry 269.12 (1994): 9006-9010.), 3X GGGGS linker (SEQ ID NO: 9), SV40 nuclear localization signal, and p65 activation domain. Functionally, the MS2 domain binds to its specific RNA aptamer, the 3XGGGGS linker (SEQ ID NO: 9) provides mechanical flexibility between the MS2 and p65 domains, the SV40 nuclear localization signal facilitates transport of the protein into the nucleus, and the p65 activation domain promotes transcriptional activation.

Example 15: Further Optimization of Functional CRISPR-Cas Systems by Multiplexing to Mediate Distinct Effects at Different Genomic Loci Simultaneously PP7 is the RNA-binding coat protein of the bacteriophage *Pseudomonas*. Like MS2, it binds a specific RNA sequence and secondary structure. The PP7 RNA-recognition motif is distinct from that of MS2. Consequently, PP7 and MS2 may be multiplexed to mediate distinct effects at different genomic loci simultaneously. For example, an sgRNA targeting locus A may be modified with MS2 loops, recruiting MS2-VP64 activators, while another sgRNA targeting locus B may be modified with PP7 loops, recruiting PP7-SID4X repressor domains (FIG. 48). In the same cell, dCas9 may thus mediate orthogonal, locus-specific modifications. This principle may be extended to incorporate other orthogonal RNA-binding proteins such as Q-beta.

PP7-effector Protein Information

Applicants construct PP7-effector constructs as previously described in Examples 13 and 14. Sequence information on these constructs are provided below:

PP7-VP64
DNA Sequence (SEQ ID NO: 169)
ATGTCCAAAACCATCGTTCTTTCGGTCGGCGAGGCTACTCGCACTCTGAC

TGAGATCCAGTCCACCGCAGACCGTCAGATCTTCGAAGAGAAGGTCGGGC

CTCTGGTGGGTCGGCTGCGCCTCACGGCTTCGCTCCGTCAAAACGGAGCC

AAGACCGCGTATCGCGTCAACCTAAAACTGGATCAGGCGGACGTCGTTGA

TTCCGGACTTCCGAAAGTGCGCTACACTCAGGTATGGTCGCACGACGTGA

CAATCGTTGCGAATAGCACCGAGGCCTCGCGCAAATCGTTGTACGATTTG

ACCAAGTCCCTCGTCGCGACCTCGCAGGTCGAAGATCTTGTCGTCAACCT

TGTGCCGCTGGGCCGTagcgctGGAGGAGGTGGAAGCGGAGGAGGAGGAA

GCGGAGGAGGAGGTAGCGgacctaagaaaaagaggaaggtggcggccgct ggatccGGACGGGCTGACGCATTGGACGATTTTGATCTGGATATGCTGGG

AAGTGACGCCCTCGATGATTTTGACCTTGACATGCTTGGTTCGGATGCCC

TTGATGACTTTGACCTCGACATGCTCGGCAGTGACGCCCTTGATGATTTC

GACCTGGACATGCTGATTAAC

Amino acid sequence (SEQ ID NO: 170)
MSKTIVLSVGEATRTLTEIQSTADRQIFEEKVGPLVGRLRLTASLRQNGA

KTAYRVNLKLDQADVVDSGLPKVRYTQVWSHDVTIVANSTEASRKSLYDL

TKSLVATSQVEDLVVNLVPLGRSAGGGGSGGGGSGGGGSGPKKKRKVAAA

GSGRADALDDFDLDMLGSDALDDFDLDMLGSDALDDFDLDMLGSDALDDF

DLDMLIN

Description

The PP7-VP64 activator protein consists of the following domains from N-term to C-term: the PP7 *Pseudomonas* bacteriophage coat protein (with amino acids 68-69 mutated to SG and amino acids 70-75 deleted from the wild type protein as described in Wu, Bin, Jeffrey A. Chao, and Robert H. Singer. "Fluorescence fluctuation spectroscopy enables quantitative imaging of single mRNAs in living cells." Biophysical journal 102.12 (2012): 2936-2944. and Chao, Jeffrey A., et al. "Structural basis for the coevolution of a viral RNA-protein complex." Nature structural & molecular biology 15.1 (2007): 103-105.), 3X GGGGS linker (SEQ ID NO: 9), SV40 nuclear localization signal, and VP64 activation domain. Functionally, the PP7 domain binds to its specific RNA aptamer, the 3XGGGGS linker (SEQ ID NO: 9) provides mechanical flexibility between the MS2 and VP64 domains, the SV40 nuclear localization signal facilitates transport of the protein into the nucleus, and the VP64 activation domain promotes transcriptional activation.

PP7-SID4×
DNA Sequence (SEQ ID NO: 171)
ATGTCCAAAACCATCGTTCTTTCGGTCGGCGAGGCTACTCGCACTCTGAC

TGAGATCCAGTCCACCGCAGACCGTCAGATCTTCGAAGAGAAGGTCGGGC

CTCTGGTGGGTCGGCTGCGCCTCACGGCTTCGCTCCGTCAAAACGGAGCC

AAGACCGCGTATCGCGTCAACCTAAAACTGGATCAGGCGGACGTCGTTGA

TTCCGGACTTCCGAAAGTGCGCTACACTCAGGTATGGTCGCACGACGTGA

CAATCGTTGCGAATAGCACCGAGGCCTCGCGCAAATCGTTGTACGATTTG

ACCAAGTCCCTCGTCGCGACCTCGCAGGTCGAAGATCTTGTCGTCAACCT

TGTGCCGCTGGGCCGTAgcgctGGAGGAGGTGGAAGCGGAGGAGGAGGAA

GCGGAGGAGGAGGTAGCggacctaagaaaaagaggaaggtggcggccgct ggatccATGAACATCCAGATGCTGCTGGAGGCCGCTGACTACCTGGAACG

GAGAGAGCGCGAAGCCGAGCACGGATATGCTTCAATGCTGCCCGGAAGCG

GCATGAATATTCAGATGCTGCTGGAGGCTGCTGATTACCTGGAAAGGCGC

GAACGGGAGGCCGAACATGGCTATGCTTCCATGCTGCCTGGGTCTGGAAT

GAATATCCAAATGCTGCTGGAGGCAGCCGATTACCTGGAACGGAGAGAAA

GAGAAGCCGAGCACGGATACGCCAGCATGCTGCCAGGCAGCGGGATGAAC

ATACAAATGCTGCTGGAGGCTGCCGATTACCTGGAGAGGCGCGAGAGAGA

AGCTGAACATGGCTATGCCTCTATGCTGCCC

Amino Acid Sequence (SEQ ID NO: 172)
MSKTIVLSVGEATRTLTEIQSTADRQIFEEKVGPLVGRLRLTASLRQNGA

KTAYRVNLKLDQADVVDSGLPKVRYTQVWSHDVTIVANSTEASRKSLYDL

TKSLVATSQVEDLVVNLVPLGRSAGGGGSGGGGSGGGGSGPKKKRKVAAA

GSMNIQMLLEAADYLERREREAEHGYASMLPGSGMNIQMLLEAADYLERR

EREAEHGYASMLPGSGMNIQMLLEAADYLERREREAEHGYASMLPGSGMN

IQMLLEAADYLERREREAEHGYASMLP

Description

The PP7-SID4X repressor protein consists of the following domains from N-term to C-term: the PP7 *Pseudomonas* bacteriophage coat protein (with amino acids 68-69 mutated to SG and amino acids 70-75 deleted from the wild type protein as described in Wu, Bin, Jeffrey A. Chao, and Robert H. Singer. "Fluorescence fluctuation spectroscopy enables quantitative imaging of single mRNAs in living cells." Biophysical journal 102.12 (2012): 2936-2944. and Chao, Jeffrey A., et al. "Structural basis for the coevolution of a viral RNA-protein complex." Nature structural & molecular biology 15.1 (2007): 103-105.), 3X GGGGS linker (SEQ ID NO: 9), SV40 nuclear localization signal, and SID4X repressor domain. Functionally, the PP7 domain binds to its specific RNA aptamer, the 3XGGGGS linker (SEQ ID NO: 9) provides mechanical flexibility between the MS2 and SID4X domains, the SV40 nuclear localization signal facilitates transport of the protein into the nucleus, and the SID4X domain represses transcriptional activity.

PP7-KRAB
DNA Sequence (SEQ ID NO: 173)
ATGTCCAAAACCATCGTTCTTTCGGTCGGCGAGGCTACTCGCACTCTGAC

TGAGATCCAGTCCACCGCAGACCGTCAGATCTTCGAAGAGAAGGTCGGGC

CTCTGGTGGGTCGGCTGCGCCTCACGGCTTCGCTCCGTCAAAACGGAGCC

AAGACCGCGTATCGCGTCAACCTAAAACTGGATCAGGCGGACGTCGTTGA

TTCCGGACTTCCGAAAGTGCGCTACACTCAGGTATGGTCGCACGACGTGA

CAATCGTTGCGAATAGCACCGAGGCCTCGCGCAAATCGTTGTACGATTTG

ACCAAGTCCCTCGTCGCGACCTCGCAGGTCGAAGATCTTGTCGTCAACCT

TGTGCCGCTGGGCCGTAgcgctGGAGGAGGTGGAAGCGGAGGAGGAGGAA

GCGGAGGAGGAGGTAGCggacctaagaaaaagaggaaggtggcggccgct ggatccgctttgtctcctcagcactctgctgtcactcaaggaagtatcat caagaacaaggagggcatggatgctaagtcactaactgcctggtcccgga cactggtgaccttcaaggatgtatttgtggacttcaccagggaggagtgg aagctgctggacactgctcagcagatcgtgtacagaaatgtgatgctgga gaactataagaacctggtttccttgggttatcagcttactaagccagatg tgatcctccggttggagaaggagaagagccctggctggtggagagagaa attcaccaagagacccatcctgattcagagactgcatttgaaatcaaatc atcagtt Amino Acid Sequence (SEQ ID NO: 174)
MSKTIVLSVGEATRTLTEIQSTADRQIFEEKVGPLVGRLRLTASLRQNGA

KTAYRVNLKLDQADVVDSGLPKVRYTQVWSHDVTIVANSTEASRKSLYDL

TKSLVATSQVEDLVVNLVPLGRSAGGGGSGGGGSGGGGSGPKKKRKVAAA

GSALSPQHSAVTQGSIIKNKEGMDAKSLTAWSRTLVTFKDVFVDFTREEW

KLLDTAQQIVYRNVMLENYKNLVSLGYQLTKPDVILRLEKGEEPWLVERE

IHQETHPDSETAFEIKSSV

Description

The PP7-KRAB repressor protein consists of the following domains from N-term to C-term: the PP7 *Pseudomonas* bacteriophage coat protein (with amino acids 68-69 mutated to SG and amino acids 70-75 deleted from the wild type protein as described in Wu, Bin, Jeffrey A. Chao, and Robert H. Singer. "Fluorescence fluctuation spectroscopy enables quantitative imaging of single mRNAs in living cells." Biophysical journal 102.12 (2012): 2936-2944. and Chao, Jeffrey A., et al. "Structural basis for the coevolution of a viral RNA-protein complex." Nature structural & molecular biology 15.1 (2007): 103-105.), 3X GGGGS linker (SEQ ID NO: 9), SV40 nuclear localization signal, and KRAB repressor domain. Functionally, the PP7 domain binds to its specific RNA aptamer, the 3XGGGGS linker (SEQ ID NO: 9) provides mechanical flexibility between the MS2 and KRAB domains, the SV40 nuclear localization signal facilitates transport of the protein into the nucleus, and the KRAB domain represses transcriptional activity.

PP7-NUE
DNA Sequence

```
                                          (SEQ ID NO: 175)
ATGTCCAAAACCATCGTTCTTTCGGTCGGCGAGGCTACTCGCACTCTGAC

TGAGATCCAGTCCACCGCAGACCGTCAGATCTTCGAAGAGAAGGTCGGGC

CTCTGGTGGGTCGGCTGCGCCTCACGGCTTCGCTCCGTCAAAACGGAGCC

AAGACCGCGTATCGCGTCAACCTAAAACTGGATCAGGCGGACGTCGTTGA

TTCCGGACTTCCGAAAGTGCGCTACACTCAGGTATGGTCGCACGACGTGA

CAATCGTTGCGAATAGCACCGAGGCCTCGCGCAAATCGTTGTACGATTTG

ACCAAGTCCCTCGTCGCGACCTCGCAGGTCGAAGATCTTGTCGTCAACCT

TGTGCCGCTGGGCCGTagcgctGGAGGAGGTGGAAGCGGAGGAGGAGGAA

GCGGAGGAGGAGGTAGCggacctaagaaaaagaggaaggtggcggccgct ggatccACTACCAACTCCACTCAGGACACACTGTATCTCAGCCTCCACGG

CGGAATCGACTCCGCCATCCCATACCCCGTGAGGAGAGTCGAGCAGCTGC

TCCAGTTCTCTTTTCTGCCCGAACTCCAGTTCCAGAACGCCGCTGTGAAA

CAGAGAATCCAGCGCCTGTGCTATAGAGAGGAAAAGCGGCTGGCTGTCAG

CTCCCTCGCAAAGTGGCTGGGCCAGCTCCACAAACAGAGGCTGAGAGCAC

CAAAGAACCCCCCTGTGGCCATTTGTTGGATCAATAGTTACGTGGGCTAT

GGAGTCTTTGCCCGGGAGTCTATTCCCGCTTGGAGTTACATCGGCGAATA

TACCGGCATCCTGCGGCGCCGACAGGCTCTGTGGCTCGACGAGAACGATT

ACTGCTTCCGCTATCCTGTGCCACGCTACTCATTCCGATATTTTACCATC

GACAGCGGGATGCAGGGTAACGTCACAAGGTTCATCAATCACTCCGATAA

CCCTAATCTGGAGGCAATCGGGGCCTTCGAAAACGGTATCTTCCATATCA

TCATCAGGGCCATCAAGGATATCCTGCCCGGGGAGGAACTCTGTTACCAC

TATGGACCTCTGTACTGGAAGCATCGAAAGAAAAGGGAGGAGTTCGTGCC

ACAGGAGGAA
```

Amino Acid Sequence

```
                                          (SEQ ID NO: 176)
MSKTIVLSVGEATRTLTEIQSTADRQIFEEKVGPLVGRLRLTASLRQNGA

KTAYRVNLKLDQADVVDSGLPKVRYTQVWSHDVTIVANSTEASRKSLYDL

TKSLVATSQVEDLVVNLVPLGRSAGGGGSGGGGSGGGGSGPKKKRKVAAA

GSTTNSTQDTLYLSLHGGIDSAIPYPVRRVEQLLQFSFLPELQFQNAAVK
```

```
-continued
QRIQRLCYREEKRLAVSSLAKWLGQLHKQRLRAPKNPPVAICWINSYVGY

GVFARESIPAWSYIGEYTGILRRRQALWLDENDYCFRYPVPRYSFRYFTI

DSGMQGNVTRFINHSDNPNLEAIGAFENGIFHIIIRAIKDILPGEELCYH

YGPLYWKHRKKREEFVPQEE
```

Description

The PP7-NUE histone effector protein consists of the following domains from N-term to C-term: the PP7 Pseudomonas bacteriophage coat protein (with amino acids 68-69 mutated to SG and amino acids 70-75 deleted from the wild type protein as described in Wu, Bin, Jeffrey A. Chao, and Robert H. Singer. "Fluorescence fluctuation spectroscopy enables quantitative imaging of single mRNAs in living cells." Biophysical journal 102.12 (2012): 2936-2944. and Chao, Jeffrey A., et al. "Structural basis for the coevolution of a viral RNA-protein complex." Nature structural & molecular biology 15.1 (2007): 103-105.), 3X GGGGS linker (SEQ ID NO: 9), SV40 nuclear localization signal, and the NUE histone methyltransferase domain from *Chlamydia trachomatis*. Functionally, the PP7 domain binds to its specific RNA aptamer, the 3XGGGGS linker (SEQ ID NO: 9) provides mechanical flexibility between the MS2 and NUE domains, the SV40 nuclear localization signal facilitates transport of the protein into the nucleus, and the NUE domain increases repressive histone methylation.

PP7-NcoR
DNA Sequence

```
                                          (SEQ ID NO: 177)
ATGTCCAAAACCATCGTTCTTTCGGTCGGCGAGGCTACTCGCACTCTGAC

TGAGATCCAGTCCACCGCAGACCGTCAGATCTTCGAAGAGAAGGTCGGGC

CTCTGGTGGGTCGGCTGCGCCTCACGGCTTCGCTCCGTCAAAACGGAGCC

AAGACCGCGTATCGCGTCAACCTAAAACTGGATCAGGCGGACGTCGTTGA

TTCCGGACTTCCGAAAGTGCGCTACACTCAGGTATGGTCGCACGACGTGA

CAATCGTTGCGAATAGCACCGAGGCCTCGCGCAAATCGTTGTACGATTTG

ACCAAGTCCCTCGTCGCGACCTCGCAGGTCGAAGATCTTGTCGTCAACCT

TGTGCCGCTGGGCCGTagcgctGGAGGAGGTGGAAGCGGAGGAGGAGGAA

GCGGAGGAGGAGGTAGCggacctaagaaaaagaggaaggtggcggccgct ggatccAACGGGCTGATGGAGGACCCAATGAAAGTCTACAAGGACAGGCA

GTTTATGAACGTGTGGACCGACCACGAGAAGGAAATCTTCAAGGATAAGT

TCATCCAGCATCCCAAAAATTTCGGCCTGATCGCCAGCTACCTGGAGAGG

AAGTCCGTGCCTGACTGCGTCCTGTACTATTACCTCACAAAGAAAAACGA

AAATTACAAA
```

Amino Acid Sequence

```
                                          (SEQ ID NO: 178)
MSKTIVLSVGEATRTLTEIQSTADRQIFEEKVGPLVGRLRLTASLRQNGA

KTAYRVNLKLDQADVVDSGLPKVRYTQVWSHDVTIVANSTEASRKSLYDL

TKSLVATSQVEDLVVNLVPLGRSAGGGGSGGGGSGGGGSGPKKKRKVAAA
```

-continued

GSNGLMEDPMKVYKDRQFMNVWTDHEKEIFKDKFIQHPKNFGLIASYLER

KSVPDCVLYYYLTKKNENYK

Description

The PP7-NcoR histone effector protein consists of the following domains from N-term to C-term: the PP7 *Pseudomonas* bacteriophage coat protein (with amino acids 68-69 mutated to SG and amino acids 70-75 deleted from the wild type protein as described in Wu, Bin, Jeffrey A. Chao, and Robert H. Singer. "Fluorescence fluctuation spectroscopy enables quantitative imaging of single mRNAs in living cells." Biophysical journal 102.12 (2012): 2936-2944. and Chao, Jeffrey A., et al. "Structural basis for the coevolution of a viral RNA-protein complex." Nature structural & molecular biology 15.1 (2007): 103-105.), 3X GGGGS linker (SEQ ID NO: 9), SV40 nuclear localization signal, and the HDAC recruiter domain of the human NcoR protein (amino acids 420-488 of wild type). Functionally, the PP7 domain binds to its specific RNA aptamer, the 3XGGGGS linker (SEQ ID NO: 9) provides mechanical flexibility between the MS2 and NcoR domains, the SV40 nuclear localization signal facilitates transport of the protein into the nucleus, and the NcoR domain recruits histone deacetylases leading to repressive histone modifications.

Other potential orthogonal RNA-binding proteins: Additional orthogonal RNA-binding protein/aptamer combinations exist within the diversity of bacteriophage coat proteins. These alternative combinations may be used to develop transcriptional modulators or DNA-effectors analogous to those Applicants have described for MS2 and PP7. A list of such coat proteins includes, but is not limited to: Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, PRR1.

Example 16: MS2 CasLITE

Further embodiments of the invention include modification of sgRNA architecture with MS2 loops as described in Examples 13 and 14 with further application in inducible CRISPR-Cas systems as described in PCT Application PCT/US2013/051418, entitled "INDUCIBLE DNA BINDING PROTEINS AND GENOME PERTURBATION TOOLS AND APPLICATIONS THEREOF" filed on Jul. 21, 2013 and published as PCT Publication WO2014018423A2 on Jan. 30, 2014, the contents of which are incorporated herein by reference in their entirety.

Applicants previously showed that CRY2 and CIB1 proteins may be fused to transcription activation domains and DNA-binding domains, respectively, in order to allow locus-specific light-inducible control of endogenous transcription (Konermann S, Brigham M D, Trevino A E, Hsu P D, Heidenreich M, Cong L, Platt R J, Scott D A, Church G M, Zhang F. "Optical control of endogenous mammalian transcription and epigenetic states." Nature. 2013 Aug. 22; 500(7463):472-6). Applicants further showed that this system may be extended to dCas9 transcriptional effectors. Applicants generate an analogous dCas9-based light-inducible MS2-effector, characterized by an MS2-CIB1 recruitment component bound to dCas9-sgRNA, and a CRY2-VP64 transcriptional activator domain. Upon activation with blue light, CRY2-VP64 associate with MS2-CM 1, enabling the recruitment of the transcriptional machinery to the target locus.

The novel MS2-CIB1 inducible recruitment complex consists of the following domains from N-term to C-term: the N55K mutant of the MS2 bacteriophage coat protein (shown to have higher binding affinity than wild type MS2 in Lim, F., M. Spingola, and D. S. Peabody. "Altering the RNA binding specificity of a translational repressor." Journal of Biological Chemistry 269.12 (1994): 9006-9010.), 3X GGGGS linker (SEQ ID NO: 9), SV40 nuclear localization signal, and p65 activation domain. Functionally, the MS2 domain binds to its specific RNA aptamer, the 3XGGGGS linker (SEQ ID NO: 9) provides mechanical flexibility between the MS2 and CIB1 domains, the SV40 nuclear localization signal facilitates transport of the protein into the nucleus, and the CIB1 domain is a heterodimeric binding partner of the light-sensitive Cryptochrome 2 (CRY2).

The alternative sgRNA designs, orthogonal RNA-binding proteins, and MS2 fusion architectures discussed in previous Examples are entirely compatible with the MS2-CIB1 fusion, with CIB1 acting as the "effector" domain. dCas9-CIB1, which are previously described, may also be compatible with MS2-CIB1—i.e., using dCas9-CIB1 and MS2-CIB1 fusions in tandem may provide functional advantages for inducible manipulation of target gene expression. Finally, optimized LITE architectures may be employed as described in Konermann et al 2013.

Sequence information for MS2 CasLITE constructs are provided below: MS2-CIB1 DNA Sequence (SEQ ID NO: 179)
ATGGCTTCAAACTTTACTCAGTTCGTGCTCGTGGACAATGGTGGGACAGG

GGATGTGACAGTGGCTCCTTCTAATTTCGCTAATGGGGTGGCAGAGTGGA

TCAGCTCCAACTCACGGAGCCAGGCCTACAAGGTGACATGCAGCGTCAGG

CAGTCTAGTGCCCAGAAgAGAAAGTATACCATCAAGGTGGAGGTCCCCAA

AGTGGCTACCCAGACAGTGGGCGGAGTCGAACTGCCTGTCGCCGCTTGGA

GGTCCTACCTGAACATGGAGCTCACTATCCCAATTTTCGCTACCAATTCT

GACTGTGAACTCATCGTGAAGGCAATGCAGGGGCTCCTCAAAGACGGTAA

TCCTATCCCTTCCGCCATCGCCGCTAACTCAGGTATCTACagcgctGGAG

GAGGTGGAAGCGGAGGAGGAGGAAGCGGAGGAGGAGGTAGCGgacctaag aaaaagaggaaggtggcggccgctggatccAACGGCGCGATTGGTGGGGA

TTTGCTGCTTAACTTTCCCGACATGTCCGTGTTGGAACGTCAGCGCGCAC

ATTTGAAGTATCTTAACCCCACCTTCGACTCCCCGTTGGCCGGGTTCTTT

GCGGACTCATCTATGATTACGGGAGGGGAAATGGACAGCTACCTCTCAAC

GGCCGGATTGAATCTTCCGATGATGTATGGAGAAACCACTGTAGAAGGCG

ACTCGCGACTCTCGATTTCGCCTGAAACGACGCTGGGAACAGGGAACTTC

AAGAAACGGAAATTCGACACGGAGACAAAAGATTGCAACGAAAAGAAGAA

GAAAATGACCATGAATCGCGATGATCTGGTAGAGGAGGGAGAGGAGGAAA

AGTCGAAGATTACTGAACAGAACAATGGGTCTACCAAAAGTATCAAAAAG

ATGAAGCACAAAGCTAAGAAAGAAGAGAACAATTTCAGCAATGACAGCAG

TAAAGTCACAAAAGAACTGGAGAAAACGGATTACATTCACGTGAGGGCGC

GACGAGGGCAGGCTACAGATTCACATTCAATTGCGGAGAGAGTACGGAGA

-continued

```
GAGAAAATCTCAGAAAGGATGAAGTTCCTCCAAGACCTTGTGCCAGGTTG

TGACAAGATCACAGGCAAAGCAGGAATGCTGGATGAGATCATCAACTACG

TCCAATCGTTGCAAAGACAAATTGAGTTTCTCTCGATGAAACTGGCCATC

GTGAATCCTAGACCGGATTTCGACATGGATGACATCTTTGCGAAAGAAGT

GGCATCCACTCCCATGACGGTTGTGCCCTCACCGGAGATGGTCTTGTCTG

GTTACAGCCACGAAATGGTGCATTCGGGTTATTCAAGCGAGATGGTCAAT

TCGGGATACCTTCACGTCAATCCCATGCAGCAGGTGAATACTTCCAGTGA

TCCACTCTCCTGCTTTAACAACGGCGAGGCCCCTTCGATGTGGGACTCCC

ACGTACAGAATCTCTATGGAAATCTCGGAGTC
```

MS2-CIB1 Amino Acid Sequence:

(SEQ ID NO: 180)
```
MASNFTQFVLVDNGGTGDVTVAPSNFANGVAEWISSNSRSQAYKVTCSVR

QSSAQKRKYTIKVEVPKVATQTVGGVELPVAAWRSYLNMELTIPIFATNS

DCELIVKAMQGLLKDGNPIPSAIAANSGIYSAGGGGSGGGGSGGGGSGPK

KKRKVAAAGSNGAIGGDLLLNFPDMSVLERQRAHLKYLNPTFDSPLAGFF

ADSSMITGGEMDSYLSTAGLNLPMMYGETTVEGDSRLSISPETTLGTGNF

KKRKFDTETKDCNEKKKKMTMNRDDLVEEGEEEKSKITEQNNGSTKSIKK

MKHKAKKEENNFSNDSSKVTKELEKTDYIHVRARRGQATDSHSIAERVRR

EKISERMKFLQDLVPGCDKITGKAGMLDEIINYVQSLQRQIEFLSMKLAI

VNPRPDFDMDDIFAKEVASTPMTVVPSPEMVLSGYSHEMVHSGYSSEMVN

SGYLHVNPMQQVNTSSDPLSCFNNGEAPSMWDSHVQNLYGNLGV
```

Example 17: New dCas9 Activator Constructs Informed by Crystal Structure Information An optimized CRISPR/Cas9 activator system requires improvements not only in the sgRNA backbone, but in the dCas9-activator fusion constructs. The Cas9/RNA/DNA crystal structure has led to the generation of several hypotheses for improving dCas9-activator function. The crystal structure showed that the C-terminus of dCas9, where the activation domain of the standard dCas9-activator is fused, is poorly localized to the target DNA. Most, but not all, of these hypotheses seek to improve dCas9-activator function by finding preferable locations for the activation domain within the dCas9 protein, rather than at the C-terminus.

In brief:
Replace dCas9 Rec2 domain with transcriptional effector domain,
Replace dCas9 HNH domain with transcriptional effector domain,
Insert transcriptional effector domain at sites of flexible linkers within dCas9: amino acid 553, 575, or 1153
Create catalytically inactive dCas9 by combination of D10A and N863A mutations, rather than D10A and H840A mutations.

Replacing the dCas9 Rec2 domain with transcriptional effector domain: The Cas9/RNA/DNA crystal structure experiments showed that a Cas9 mutant from which the Rec2 domain had been deleted maintained a significant level of nuclease activity. This finding suggests that the Rec2 domain is not essential for the formation of the Cas9/RNA/DNA complex. We hypothesize that replacing the Rec2 domain in dCas9 with a transcriptional effector domain would not inhibit formation of the dCas9/RNA/DNA complex and could facilitate a more efficient interaction between the transcriptional effector domain and the target DNA. Several constructs have been synthesized to investigate this theory.

In each case amino acids 175-306 of dCas9 were replaced with one of the following inserts, with subdomains listed from N- to C-terminus:
VP64 activation domain
3X GGGGS linker (SEQ ID NO: 9), VP64 activation domain, 3X GGGGS linker (SEQ ID NO: 9)
p65 activation domain
3X GGGGS linker (SEQ ID NO: 9), p65 activation domain, 3X GGGGS linker (SEQ ID NO: 9)
Corresponding Constructs

| | |
|---|---|
| pSAMca042 | dCas(hel2-->vp64) |
| pSAMca043 | dCas(hel2-->vp64, GSlinker) |
| pSAMca044 | dCas(hel2-->P65) |
| pSAMca045 | dCas(hel2-->P65 GSlinker) |

Replacing the HNH domain with a transcriptional effector domain: Based on the crystal structure, the HNH domain is located close to the DNA/RNA hybrid. In addition, it was found that it is a flexible domain that can move as a consequence of conformational changes while Cas9 is binding target DNA. It is flanked by a disordered linker on the N-term and the a39-a40 linker on the C-term, which can undergo a conformational change to an extended a-helix, moving the HNH domain closer to its target DNA bases. The proximity to target DNA and the flexibility identified in the crystal make a replacement of this nuclease domain with a transcriptional effector domain promising. See FIG. 49 for illustration.

Applicants replace AA775-901 (of the HNH domain) with either vp64 or P65 flanked by a (GGGGS)3 (SEQ ID NO: 9) or a (GGGGS)6 (SEQ ID NO: 10) linker on both sides of the inserted transcriptional effector domain.
Corresponding Constructs

| | |
|---|---|
| pSAMca050 | dCas9(HNH-->vp64, 3XGS) |
| pSAMca051 | dCas9(HNH-->vp64, 6XGS) |
| pSAMca052 | dCas9(HNH-->P65, 3XGS) |
| pSAMca053 | dCas9(HNH-->P65, 6XGS) |

Insertions of transcriptional domains into 3 loops of dCas9:

In addition to replacing an existing domain (e.g. HNH, Rec2) with a transcriptional effector domain, it may be possible to insert a transcriptional effector domain at different positions in the Cas9 protein. The crystal structure helps in identifying promising loops for such an insertion (favorable properties for a place for insertion include low secondary structure complexity (loop versus helix or sheet, unobstructed space for the additional domain, proximity to target DNA and no current interactions with either target DNA or sgRNA (as these may be disrupted by the addition of the transcriptional effector domain)).

Applicants identified three favorable positions: G533, F575 and K1153. The locations of G533 and K1153 in the Cas9 protein is indicated in the corresponding FIG. 49. Applicants insert either vp64 or P65 flanked by a (GGGGS)1 (SEQ ID NO: 14) or a (GGGGS)3 (SEQ ID NO:

9) linker on both sides of the inserted transcriptional effector domain at these three locations.
Corresponding Constructs

| | |
|---|---|
| pSAMca054 | dCas9(G533-vp64, 1XGS) |
| pSAMca055 | dCas9(G533-vp64, 3XGS) |
| pSAMca056 | dCas9(G533-P65, 1XGS) |
| pSAMca057 | dCas9(G533-P65, 3XGS) |
| pSAMca058 | dCas9(F575-vp64, 1XGS) |
| pSAMca059 | dCas9(F575-vp64, 3XGS) |
| pSAMca060 | dCas9(F575-P65, 1XGS) |
| pSAMca061 | dCas9(F575-P65, 3XGS) |
| pSAMca062 | dCas9(K1153-vp64, 1XGS) |
| pSAMca063 | dCas9(K1153-vp64, 3XGS) |
| pSAMca064 | dCas9(K1153-P65, 1XGS) |
| pSAMca065 | dCas9(K1153-P65, 3XGS) | dCas activator sequence information is provided below:
Replacing the dCas9 Rec2 domain with transcriptional effector domain pSAMca042 dCas(hel2-->vp64) - DNA
(SEQ ID NO: 181)
```
atgGACAAGAAGTACAGCATCGGCCTGGCCATCGGCACCAACTCTGTGGG
CTGGGCCGTGATCACCGACGAGTACAAGGTGCCCAGCAAGAAATTCAAGG
TGCTGGGCAACACCGACCGGCACAGCATCAAGAAGAACCTGATCGGAGCC
CTGCTGTTCGACAGCGGCGAAACAGCCGAGGCCACCCGGCTGAAGAGAAC
CGCCAGAAGAAGATACACCAGACGGAAGAACCGGATCTGCTATCTGCAAG
AGATCTTCAGCAACGAGATGGCCAAGGTGGACGACAGCTTCTTCCACAGA
CTGGAAGAGTCCTTCCTGGTGGAAGAGGATAAGAAGCACGAGCGGCACCC
CATCTTCGGCAACATCGTGGACGAGGTGGCCTACCACGAGAAGTACCCCA
CCATCTACCACCTGAGAAAGAAACTGGTGGACAGCACCGACAAGGCCGAC
CTGCGGCTGATCTATCTGGCCCTGGCCCACATGATCAAGTTCCGGGGCCA
CTTCCTGATCGAGGGCGACCTGAACGGACGGGCTGACGCATTGGACGATT
TTGATCTGGATATGCTGGGAAGTGACGCCCTCGATGATTTTGACCTTGAC
ATGCTTGGTTCGGATGCCCTTGATGACTTTGACCTCGACATGCTCGGCAG
TGACGCCCTTGATGATTTCGACCTGGACATGCTGATTAACAGAGTGAACA
CCGAGATCACCAAGGCCCCCCTGAGCGCCTCTATGATCAAGAGATACGAC
GAGCACCACCAGGACCTGACCCTGCTGAAAGCTCTCGTGCGGCAGCAGCT
GCCTGAGAAGTACAAAGAGATTTTCTTCGACCAGAGCAAGAACGGCTACG
CCGGCTACATTGACGGCGGAGCCAGCCAGGAAGAGTTCTACAAGTTCATC
AAGCCCATCCTGGAAAAGATGGACGGCACCGAGGAACTGCTCGTGAAGCT
GAACAGAGAGGACCTGCTGCGGAAGCAGCGGACCTTCGACAACGGCAGCA
TCCCCCACCAGATCCACCTGGGAGAGCTGCACGCCATTCTGCGGCGGCAG
GAAGATTTTTACCCATTCCTGAAGGACAACCGGGAAAAGATCGAGAAGAT
CCTGACCTTCCGCATCCCCTACTACGTGGGCCCTCTGGCCAGGGGAAACA
GCAGATTCGCCTGGATGACCAGAAAGAGCGAGGAAACCATCACCCCCTGG
AACTTCGAGGAAGTGGTGGACAAGGGCGCTTCCGCCCAGAGCTTCATCGA
GCGGATGACCAACTTCGATAAGAACCTGCCCAACGAGAAGGTGCTGCCCA
AGCACAGCCTGCTGTACGAGTACTTCACCGTGTATAACGAGCTGACCAAA
```

-continued
```
GTGAAATACGTGACCGAGGGAATGAGAAAGCCCGCCTTCCTGAGCGGCGA
GCAGAAAAAGGCCATCGTGGACCTGCTGTTCAAGACCAACCGGAAAGTGA
CCGTGAAGCAGCTGAAAGAGGACTACTTCAAGAAAATCGAGTGCTTCGAC
TCCGTGGAAATCTCCGGCGTGGAAGATCGGTTCAACGCCTCCCTGGGCAC
ATACCACGATCTGCTGAAAATTATCAAGGACAAGGACTTCCTGGACAATG
AGGAAAACGAGGACATTCTGGAAGATATCGTGCTGACCCTGACACTGTTT
GAGGACAGAGAGATGATCGAGGAACGGCTGAAAACCTATGCCCACCTGTT
CGACGACAAAGTGATGAAGCAGCTGAAGCGGCGGAGATACACCGGCTGGG
GCAGGCTGAGCCGGAAGCTGATCAACGGCATCCGGGACAAGCAGTCCGGC
AAGACAATCCTGGATTTCCTGAAGTCCGACGGCTTCGCCAACAGAAACTT
CATGCAGCTGATCCACGACGACAGCCTGACCTTTAAAGAGGACATCCAGA
AAGCCCAGGTGTCCGGCCAGGGCGATAGCCTGCACGAGCACATTGCCAAT
CTGGCCGGCAGCCCCGCCATTAAGAAGGGCATCCTGCAGACAGTGAAGGT
GGTGGACGAGCTCGTGAAAGTGATGGGCCGGCACAAGCCCGAGAACATCG
TGATCGAAATGGCCAGAGAGAACCAGACCACCCAGAAGGGACAGAAGAAC
AGCCGCGAGAGAATGAAGCGGATCGAAGAGGGCATCAAAGAGCTGGGCAG
CCAGATCCTGAAAGAACACCCCGTGGAAAACACCCAGCTGCAGAACGAGA
AGCTGTACCTGTACTACCTGCAGAATGGGCGGGATATGTACGTGGACCAG
GAACTGGACATCAACCGGCTGTCCGACTACGATGTGGACgcTATCGTGCC
TCAGAGCTTTCTGAAGGACGACTCCATCGACAACAAGGTGCTGACCAGAA
GCGACAAGAACCGGGGCAAGAGCGACAACGTGCCCTCCGAAGAGGTCGTG
AAGAAGATGAAGAACTACTGGCGGCAGCTGCTGAACGCCAAGCTGATTAC
CCAGAGAAAGTTCGACAATCTGACCAAGGCCGAGAGAGGCGGCCTGAGCG
AACTGGATAAGGCCGGCTTCATCAAGAGACAGCTGGTGGAAACCCGGCAG
ATCACAAAGCACGTGGCACAGATCCTGGACTCCCGGATGAACACTAAGTA
CGACGAGAATGACAAGCTGATCCGGGAAGTGAAAGTGATCACCCTGAAGT
CCAAGCTGGTGTCCGATTTCCGGAAGGATTTCCAGTTTTACAAAGTGCGC
GAGATCAACAACTACCACCACGCCCACGACGCCTACCTGAACGCCGTCGT
GGGAACCGCCCTGATCAAAAAGTACCCTAAGCTGGAAAGCGAGTTCGTGT
ACGGCGACTACAAGGTGTACGACGTGCGGAAGATGATCGCCAAGAGCGAG
CAGGAAATCGGCAAGGCTACCGCCAAGTACTTCTTCTACAGCAACATCAT
GAACTTTTTCAAGACCGAGATTACCCTGGCCAACGGCGAGATCCGGAAGC
GGCCTCTGATCGAGACAAACGGCGAAACCGGGGAGATCGTGTGGGATAAG
GGCCGGGATTTTGCCACCGTGCGGAAAGTGCTGAGCATGCCCCAAGTGAA
TATCGTGAAAAAGACCGAGGTGCAGACAGGCGGCTTCAGCAAAGAGTCTA
TCCTGCCCAAGAGGAACAGCGATAAGCTGATCGCCAGAAAGAAGGACTGG
GACCCTAAGAAGTACGGCGGCTTCGACAGCCCCACCGTGGCCTATTCTGT
GCTGGTGGTGGCCAAAGTGGAAAAGGGCAAGTCCAAGAAACTGAAGAGTG
TGAAAGAGCTGCTGGGGATCACCATCATGGAAAGAAGCAGCTTCGAGAAG
AATCCCATCGACTTTCTGGAAGCCAAGGGCTACAAAGAAGTGAAAAAGGA
CCTGATCATCAAGCTGCCTAAGTACTCCCTGTTCGAGCTGGAAAACGGCC
```

-continued

GGAAGAGAATGCTGGCCTCTGCCGGCGAACTGCAGAAGGGAAACGAACTG

GCCCTGCCCTCCAAATATGTGAACTTCCTGTACCTGGCCAGCCACTATGA

GAAGCTGAAGGGCTCCCCCGAGGATAATGAGCAGAAACAGCTGTTTGTGG

AACAGCACAAGCACTACCTGGACGAGATCATCGAGCAGATCAGCGAGTTC

TCCAAGAGAGTGATCCTGGCCGACGCTAATCTGGACAAAGTGCTGTCCGC

CTACAACAAGCACCGGGATAAGCCCATCAGAGAGCAGGCCGAGAATATCA

TCCACCTGTTTACCCTGACCAATCTGGGAGCCCCTGCCGCCTTCAAGTAC

TTTGACACCACCATCGACCGGAAGAGGTACACCAGCACCAAAGAGGTGCT

GGACGCCACCCTGATCCACCAGAGCATCACCGGCCTGTACGAGACACGGA

TCGACCTGTCTCAGCTGGGAGGCGACAgcgctGGAGGAGGTGGAAGCGGA

GGAGGAGGAAGCGGAGGAGGAGGTAGCggacctaagaaaaagaggaagt ggcggccgct pSAMca042 dCas(hel2-->vp64) - amino acid
(SEQ ID NO: 182)
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNGRADALDDFDLDMLGSDALDDFDLD

MLGSDALDDFDLDMLGSDALDDFDLDMLINRVNTEITKAPLSASMIKRYD

EHHQDLTLLKALVRQQLPEKYKEIFFDQSKNGYAGYIDGGASQEEFYKFI

KPILEKMDGTEELLVKLNREDLLRKQRTFDNGSIPHQIHLGELHAILRRQ

EDFYPFLKDNREKIEKILTFRIPYYVGPLARGNSRFAWMTRKSEETITPW

NFEEVVDKGASAQSFIERMTNFDKNLPNEKVLPKHSLLYEYFTVYNELTK

VKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLF

EDREMIEERLKTYAHLFDDKVMKQLKRRRYTGWGRLSRKLINGIRDKQSG

KTILDFLKSDGFANRNFMQLIHDDSLTFKEDIQKAQVSGQGDSLHEHIAN

LAGSPAIKKGILQTVKVVDELVKVMGRHKPENIVIEMARENQTTQKGQKN

SRERMKRIEEGIKELGSQILKEHPVENTQLQNEKLYLYYLQNGRDMYVDQ

ELDINRLSDYDVDAIVPQSFLKDDSIDNKVLTRSDKNRGKSDNVPSEEVV

KKMKNYWRQLLNAKLITQRKFDNLTKAERGGLSELDKAGFIKRQLVETRQ

ITKHVAQILDSRMNTKYDENDKLIREVKVITLKSKLVSDFRKDFQFYKVR

EINNYHHAHDAYLNAVVGTALIKKYPKLESEFVYGDYKVYDVRKMIAKSE

QEIGKATAKYFFYSNIMNFFKTEITLANGEIRKRPLIETNGETGEIVWDK

GRDFATVRKVLSMPQVNIVKKTEVQTGGFSKESILPKRNSDKLIARKKDW

DPKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISEF

SKRVILADANLDKVLSAYNKHRDKPIREQAENIIHLFTLTNLGAPAAFKY

FDTTIDRKRYTSTKEVLDATLIHQSITGLYETRIDLSQLGGDSAGGGSG

GGGSGGGGSGPKKKRKVAAA pSAMca043 dCas(hel2-->vp64, GSlinker) - DNA
(SEQ ID NO: 183)
atgGACAAGAAGTACAGCATCGGCCTGGCCATCGGCACCAACTCTGTGGG

CTGGGCCGTGATCACCGACGAGTACAAGGTGCCCAGCAAGAAATTCAAGG

TGCTGGGCAACACCGACCGGCACAGCATCAAGAAGAACCTGATCGGAGCC

CTGCTGTTCGACAGCGGCGAAACAGCCGAGGCCACCCGGCTGAAGAGAAC

CGCCAGAAGAAGATACACCAGACGGAAGAACCGGATCTGCTATCTGCAAG

AGATCTTCAGCAACGAGATGGCCAAGGTGGACGACAGCTTCTTCCACAGA

CTGGAAGAGTCCTTCCTGGTGGAAGAGGATAAGAAGCACGAGCGGCACCC

CATCTTCGGCAACATCGTGGACGAGGTGGCCTACCACGAGAAGTACCCCA

CCATCTACCACCTGAGAAAGAAACTGGTGGACAGCACCGACAAGGCCGAC

CTGCGGCTGATCTATCTGGCCCTGGCCCACATGATCAAGTTCCGGGGCCA

CTTCCTGATCGAGGGCGACCTGAACGGCCGGGGAGGCTCCGGTGGTGGGG

GCAGCGGAGGGGGGGCAGCGGACGGGCTGACGCATTGGACGATTTTGAT

CTGGATATGCTGGGAAGTGACGCCCTCGATGATTTTGACCTTGACATGCT

TGGTTCGGATGCCCTTGATGCTTTGACCTCGACATGCTCGGCAGTGACG

CCCTTGATGATTTCGACCTGGACATGCTGATTAACGGCGGGGGAGGCTCC

GGTGGTGGGGGCAGCGGAGGGGGGGGCAGCAGAGTGAACACCGAGATCAC

CAAGGCCCCCCTGAGCGCCTCTATGATCAAGAGATACGACGAGCACCACC

AGGACCTGACCCTGCTGAAAGCTCTCGTGCGGCAGCAGCTGCCTGAGAAG

TACAAAGAGATTTTCTTCGACCAGAGCAAGAACGGCTACGCCGGCTACAT

TGACGGCGGAGCCAGCCAGGAAGAGTTCTACAAGTTCATCAAGCCCATCC

TGGAAAAGATGGACGGCACCGAGGAACTGCTCGTGAAGCTGAACAGAGAG

GACCTGCTGCGAAGCAGCGGACCTTCGACAACGGCAGCATCCCCCACCA

GATCCACCTGGGAGAGCTGCACGCCATTCTGCGGCGGCAGGAAGATTTTT

ACCCATTCCTGAAGGACAACCGGGAAAAGATCGAGAAGATCCTGACCTTC

CGCATCCCCTACTACGTGGGCCCTCTGGCCAGGGGAAACAGCAGATTCGC

CTGGATGACCAGAAAGAGCGAGGAAACCATCACCCCCTGGAACTTCGAGG

AAGTGGTGGACAAGGGCGCTTCCGCCCAGAGCTTCATCGAGCGGATGACC

AACTTCGATAAGAACCTGCCCAACGAGAAGGTGCTGCCCAAGCACAGCCT

GCTGTACGAGTACTTCACCGTGTATAACGAGCTGACCAAAGTGAAATACG

TGACCGAGGGAATGAGAAAGCCCGCCTTCCTGAGCGGCGAGCAGAAAAAG

GCCATCGTGGACCTGCTGTTCAAGACCAACCGGAAAGTGACCGTGAAGCA

GCTGAAAGAGGACTACTTCAAGAAATCGAGTGCTTCGACTCCGTGGAAA

TCTCCGGCGTGGAAGATCGGTTCAACGCCTCCCTGGGCACATACCACGAT

CTGCTGAAAATTATCAAGGACAAGGACTTCCTGGACAATGAGGAAAACGA

GGACATTCTGGAAGATATCGTGCTGACCCTGACACTGTTTGAGGACAGAG

AGATGATCGAGGAACGGCTGAAAACCTATGCCCACCTGTTCGACGACAAA

GTGATGAAGCAGCTGAAGCGGCGGAGATACACCGGCTGGGGCAGGCTGAG

CCGGAAGCTGATCAACGGCATCCGGGACAAGCAGTCCGGCAAGACAATCC

TGGATTTCCTGAAGTCCGACGGCTTCGCCAACAGAAACTTCATGCAGCTG

ATCCACGACGACAGCCTGACCTTTAAAGAGGACATCCAGAAAGCCCAGGT

```
GTCCGGCCAGGGCGATAGCCTGCACGAGCACATTGCCAATCTGGCCGGCA
GCCCCGCCATTAAGAAGGGCATCCTGCAGACAGTGAAGGTGGTGGACGAG
CTCGTGAAAGTGATGGGCCGGCACAAGCCCGAGAACATCGTGATCGAAAT
GGCCAGAGAGAACCAGACCACCCAGAAGGGACAGAAGAACAGCCGCGAGA
GAATGAAGCGGATCGAAGAGGGCATCAAAGAGCTGGGCAGCCAGATCCTG
AAAGAACACCCCGTGGAAAACACCCAGCTGCAGAACGAGAAGCTGTACCT
GTACTACCTGCAGAATGGGCGGGATATGTACGTGGACCAGGAACTGGACA
TCAACCGGCTGTCCGACTACGATGTGGACGcTATCGTGCCTCAGAGCTTT
CTGAAGGACGACTCCATCGACAACAAGGTGCTGACCAGAAGCGACAAGAA
CCGGGGCAAGAGCGACAACGTGCCCTCCGAAGAGGTCGTGAAGAAGATGA
AGAACTACTGGCGGCAGCTGCTGAACGCCAAGCTGATTACCCAGAGAAAG
TTCGACAATCTGACCAAGGCCGAGAGAGGCGGCCTGAGCGAACTGGATAA
GGCCGGCTTCATCAAGAGACAGCTGGTGGAAACCCGGCAGATCACAAAGC
ACGTGGCACAGATCCTGGACTCCCGGATGAACACTAAGTACGACGAGAAT
GACAAGCTGATCCGGGAAGTGAAAGTGATCACCCTGAAGTCCAAGCTGGT
GTCCGATTTCCGGAAGGATTTCCAGTTTTACAAAGTGCGCGAGATCAACA
ACTACCACCACGCCCACGACGCCTACCTGAACGCCGTCGTGGGAACCGCC
CTGATCAAAAAGTACCCTAAGCTGGAAAGCGAGTTCGTGTACGGCGACTA
CAAGGTGTACGACGTGCGGAAGATGATCGCCAAGAGCGAGCAGGAAATCG
GCAAGGCTACCGCCAAGTACTTCTTCTACAGCAACATCATGAACTTTTTC
AAGACCGAGATTACCCTGGCCAACGGCGAGATCCGGAAGCGGCCTCTGAT
CGAGACAAACGGCGAAACCGGGGAGATCGTGTGGGATAAGGGCCGGGATT
TTGCCACCGTGCGGAAAGTGCTGAGCATGCCCCAAGTGAATATCGTGAAA
AAGACCGAGGTGCAGACAGGCGGCTTCAGCAAAGAGTCTATCCTGCCCAA
GAGGAACAGCGATAAGCTGATCGCCAGAAAGAAGGACTGGGACCCTAAGA
AGTACGGCGGCTTCGACAGCCCCACCGTGGCCTATTCTGTGCTGGTGGTG
GCCAAAGTGGAAAAGGGCAAGTCCAAGAAACTGAAGAGTGTGAAAGAGCT
GCTGGGGATCACCATCATGGAAAGAAGCAGCTTCGAGAAGAATCCCATCG
ACTTTCTGGAAGCCAAGGGCTACAAAGAAGTGAAAAAGGACCTGATCATC
AAGCTGCCTAAGTACTCCCTGTTCGAGCTGGAAAACGGCCGGAAGAGAAT
GCTGGCCTCTGCCGGCGAACTGCAGAAGGGAAACGAACTGGCCCTGCCCT
CCAAATATGTGAACTTCCTGTACCTGGCCAGCCACTATGAGAAGCTGAAG
GGCTCCCCCGAGGATAATGAGCAGAAACAGCTGTTTGTGGAACAGCACAA
GCACTACCTGGACGAGATCATCGAGCAGATCAGCGAGTTCTCCAAGAGAG
TGATCCTGGCCGACGCTAATCTGGACAAAGTGCTGTCCGCCTACAACAAG
CACCGGGATAAGCCCATCAGAGAGCAGGCCGAGAATATCATCCACCTGTT
TACCCTGACCAATCTGGGAGCCCCTGCCGCCTTCAAGTACTTTGACACCA
CCATCGACCGGAAGAGGTACACCAGCACCAAAGAGGTGCTGGACGCCACC
CTGATCCACCAGAGCATCACCGGCCTGTACGAGACACACGGATCGACCTGTC
```

TCAGCTGGGAGGCGACAgcgctGGAGGAGGTGGAAGCGGAGGAGGAGGAA
GCGGAGGAGGAGGTAGCggacctaagaaaaagaggaaggtggcggccgct
pSAMca043 dCas(hel2-->vp64, GSlinker) - amino acid
(SEQ ID NO: 184)
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNGGGGSGGGGSGGGGSGRADALDDFD
LDMLGSDALDDFDLDMLGSDALDDFDLDMLGSDALDDFDLDMLINGGGGS
GGGGSGGGGSRVNTEITKAPLSASMIKRYDEHHQDLTLLKALVRQQLPEK
YKEIFFDQSKNGYAGYIDGGASQEEFYKFIKPILEKMDGTEELLVKLNRE
DLLRKQRTFDNGSIPHQIHLGELHAILRRQEDFYPFLKDNREKIEKILTF
RIPYYVGPLARGNSRFAWMTRKSEETITPWNFEEVVDKGASAQSFIERMT
NFDKNLPNEKVLPKHSLLYEYFTVYNELTKVKYVTEGMRKPAFLSGEQKK
AIVDLLFKTNRKVTVKQLKEDYFKKIECFDSVEISGVEDRFNASLGTYHD
LLKIIKDKDFLDNEENEDILEDIVLTLTLFEDREMIEERLKTYAHLFDDK
VMKQLKRRRYTGWGRLSRKLINGIRDKQSGKTILDFLKSDGFANRNFMQL
IHDDSLTFKEDIQKAQVSGQGDSLHEHIANLAGSPAIKKGILQTVKVVDE
LVKVMGRHKPENIVIEMARENQTTQKGQKNSRERMKRIEEGIKELGSQIL
KEHPVENTQLQNEKLYLYYLQNGRDMYVDQELDINRLSDYDVDAIVPQSF
LKDDSIDNKVLTRSDKNRGKSDNVPSEEVVKKMKNYWRQLLNAKLITQRK
FDNLTKAERGGLSELDKAGFIKRQLVETRQITKHVAQILDSRMNTKYDEN
DKLIREVKVITLKSKLVSDFRKDFQFYKVREINNYHHAHDAYLNAVVGTA
LIKKYPKLESEFVYGDYKVYDVRKMIAKSEQEIGKATAKYFFYSNIMNFF
KTEITLANGEIRKRPLIETNGETGEIVWDKGRDFATVRKVLSMPQVNIVK
KTEVQTGGFSKESILPKRNSDKLIARKKDWDPKKYGGFDSPTVAYSVLVV
AKVEKGKSKKLKSVKELLGITIMERSSFEKNPIDFLEAKGYKEVKKDLII
KLPKYSLFELENGRKRMLASAGELQKGNELALPSKYVNFLYLASHYEKLK
GSPEDNEQKQLFVEQHKHYLDEIIEQISEFSKRVILADANLDKVLSAYNK
HRDKPIREQAENIIHLFTLTNLGAPAAFKYFDTTIDRKRYTSTKEVLDAT
LIHQSITGLYETRIDLSQLGGDSAGGGGSGGGGSGGGGSGPKKKRKVAAA
pSAMca044 dCas(hel2-->P65) - DNA
(SEQ ID NO: 185)
atgGACAAGAAGTACAGCATCGGCCTGGCCATCGGCACCAACTCTGTGGG
CTGGGCCGTGATCACCGACGAGTACAAGGTGCCCAGCAAGAAATTCAAGG
TGCTGGGCAACACCGACCGGCACAGCATCAAGAAGAACCTGATCGGAGCC
CTGCTGTTCGACAGCGGCGAAACAGCCGAGGCCACCCGGCTGAAGAGAAC
CGCCAGAAGAAGATACACCAGACGGAAGAACCGGATCTGCTATCTGCAAG
AGATCTTCAGCAACGAGATGGCCAAGGTGGACGACAGCTTCTTCCACAGA
CTGGAAGAGTCCTTCCTGGTGGAAGAGGATAAGAAGCACGAGCGGCACCC
CATCTTCGGCAACATCGTGGACGAGGTGGCCTACCACGAGAAGTACCCCA
CCATCTACCACCTGAGAAAGAAACTGGTGGACAGCACCGACAAGGCCGAC
```

```
CTGCGGCTGATCTATCTGGCCCTGGCCCACATGATCAAGTTCCGGGGCCA
CTTCCTGATCGAGGGCGACCTGAACCCTTCAGGGCAGATCAGCAACCAGG
CCCTGGCTCTGGCCCCTAGCTCCGCTCCAGTGCTGGCCCAGACTATGGTG
CCCTCTAGTGCTATGGTGCCTCTGGCCCAGCCACCTGCTCCAGCCCCTGT
GCTGACCCCAGGACCACCCCAGTCACTGAGCGCTCCAGTGCCCAAGTCTA
CACAGGCCGGCGAGGGGACTCTGAGTGAAGCTCTGCTGCACCTGCAGTTC
GACGCTGATGAGGACCTGGGAGCTCTGCTGGGGAACAGCACCGATCCCGG
AGTGTTCACAGATCTGGCCTCCGTGGACAACTCTGAGTTTCAGCAGCTGC
TGAATCAGGGCGTGTCCATGTCTCATAGTACAGCCGAACCAATGCTGATG
GAGTACCCCGAAGCCATTACCCGGCTGGTGACCGGCAGCCAGCGGCCCCC
CGACCCCGCTCCAACTCCCCTGGGAACCAGCGGCCTGCCTAATGGGCTGT
CCGGAGATGAAGACTTCTCAAGCATCGCTGATATGGACTTTAGTGCCCTG
CTGTCACAGATTTCCTCTAGTGGGCAGAGAGTGAACACCGAGATCACCAA
GGCCCCCCTGAGCGCCTCTATGATCAAGAGATACGACGAGCACCACCAGG
ACCTGACCCTGCTGAAAGCTCTCGTGCGGCAGCAGCTGCCTGAGAAGTAC
AAAGAGATTTTCTTCGACCAGAGCAAGAACGGCTACGCCGGCTACATTGA
CGGCGGAGCCAGCCAGGAAGAGTTCTACAAGTTCATCAAGCCCATCCTGG
AAAAGATGGACGGCACCGAGGAACTGCTCGTGAAGCTGAACAGAGAGGAC
CTGCTGCGGAAGCAGCGGACCTTCGACAACGGCAGCATCCCCCACCAGAT
CCACCTGGGAGAGCTGCACGCCATTCTGCGGCGGCAGGAAGATTTTTACC
CATTCCTGAAGGACAACCGGGAAAAGATCGAGAAGATCCTGACCTTCCGC
ATCCCCTACTACGTGGGCCCTCTGGCCAGGGGAAACAGCAGATTCGCCTG
GATGACCAGAAAGAGCGAGGAAACCATCACCCCCTGGAACTTCGAGGAAG
TGGTGGACAAGGGCGCTTCCGCCCAGAGCTTCATCGAGCGGATGACCAAC
TTCGATAAGAACCTGCCCAACGAGAAGGTGCTGCCCAAGCACAGCCTGCT
GTACGAGTACTTCACCGTGTATAACGAGCTGACCAAAGTGAAATACGTGA
CCGAGGGAATGAGAAAGCCCGCCTTCCTGAGCGGCGAGCAGAAAAAGGCC
ATCGTGGACCTGCTGTTCAAGACCAACCGGAAAGTGACCGTGAAGCAGCT
GAAAGAGGACTACTTCAAGAAAATCGAGTGCTTCGACTCCGTGGAAATCT
CCGGCGTGGAAGATCGGTTCAACGCCTCCCTGGGCACATACCACGATCTG
CTGAAAATTATCAAGGACAAGGACTTCCTGGACAATGAGGAAAACGAGGA
CATTCTGGAAGATATCGTGCTGACCCTGACACTGTTTGAGGACAGAGAGA
TGATCGAGGAACGGCTGAAAACCTATGCCCACCTGTTCGACGACAAAGTG
ATGAAGCAGCTGAAGCGGCGGAGATACACCGGCTGGGGCAGGCTGAGCCG
GAAGCTGATCAACGGCATCCGGGACAAGCAGTCCGGCAAGACAATCCTGG
ATTTCCTGAAGTCCGACGGCTTCGCCAACAGAAACTTCATGCAGCTGATC
CACGACGACAGCCTGACCTTTAAAGAGGACATCCAGAAAGCCCAGGTGTC
CGGCCAGGGCGATAGCCTGCACGAGCACATTGCCAATCTGGCCGGCAGCC
CCGCCATTAAGAAGGGCATCCTGCAGACAGTGAAGGTGGTGGACGAGCTC
GTGAAAGTGATGGGCCGGCACAAGCCCGAGAACATCGTGATCGAAATGGC
CAGAGAGAACCAGACCACCCAGAAGGGACAGAAGAACAGCCGCGAGAGAA
TGAAGCGGATCGAAGAGGGCATCAAAGAGCTGGGCAGCCAGATCCTGAAA
GAACACCCCGTGGAAAACACCCAGCTGCAGAACGAGAAGCTGTACCTGTA
CTACCTGCAGAATGGGCGGGATATGTACGTGGACCAGGAACTGGACATCA
ACCGGCTGTCCGACTACGATGTGGACgcTATCGTGCCTCAGAGCTTTCTG
AAGGACGACTCCATCGACAACAAGGTGCTGACCAGAAGCGACAAGAACCG
GGGCAAGAGCGACAACGTGCCCTCCGAAGAGGTCGTGAAGAAGATGAAGA
ACTACTGGCGGCAGCTGCTGAACGCCAAGCTGATTACCCAGAGAAAGTTC
GACAATCTGACCAAGGCCGAGAGAGGCGGCCTGAGCGAACTGGATAAGGC
CGGCTTCATCAAGAGACAGCTGGTGGAAACCCGGCAGATCACAAAGCACG
TGGCACAGATCCTGGACTCCCGGATGAACACTAAGTACGACGAGAATGAC
AAGCTGATCCGGGAAGTGAAAGTGATCACCCTGAAGTCCAAGCTGGTGTC
CGATTTCCGGAAGGATTTCCAGTTTTACAAAGTGCGCGAGATCAACAACT
ACCACCACGCCCACGACGCCTACCTGAACGCCGTCGTGGGAACCGCCCTG
ATCAAAAAGTACCCTAAGCTGGAAAGCGAGTTCGTGTACGGCGACTACAA
GGTGTACGACGTGCGGAAGATGATCGCCAAGAGCGAGCAGGAAATCGGCA
AGGCTACCGCCAAGTACTTCTTCTACAGCAACATCATGAACTTTTTCAAG
ACCGAGATTACCCTGGCCAACGGCGAGATCCGGAAGCGGCCTCTGATCGA
GACAAACGGCGAAACCGGGGAGATCGTGTGGGATAAGGGCCGGGATTTTG
CCACCGTGCGGAAAGTGCTGAGCATGCCCCAAGTGAATATCGTGAAAAAG
ACCGAGGTGCAGACAGGCGGCTTCAGCAAAGAGTCTATCCTGCCCAAGAG
GAACAGCGATAAGCTGATCGCCAGAAAGAAGGACTGGGACCCTAAGAAGT
ACGGCGGCTTCGACAGCCCCACCGTGGCCTATTCTGTGCTGGTGGTGGCC
AAAGTGGAAAAGGGCAAGTCCAAGAAACTGAAGAGTGTGAAAGAGCTGCT
GGGGATCACCATCATGGAAAGAAGCAGCTTCGAGAAGAATCCCATCGACT
TTCTGGAAGCCAAGGGCTACAAAGAAGTGAAAAAGGACCTGATCATCAAG
CTGCCTAAGTACTCCCTGTTCGAGCTGGAAAACGGCCGGAAGAGAATGCT
GGCCTCTGCCGGCGAACTGCAGAAGGGAAACGAACTGGCCCTGCCCTCCA
AATATGTGAACTTCCTGTACCTGGCCAGCCACTATGAGAAGCTGAAGGGC
TCCCCCGAGGATAATGAGCAGAAACAGCTGTTTGTGGAACAGCACAAGCA
CTACCTGGACGAGATCATCGAGCAGATCAGCGAGTTCTCCAAGAGAGTGA
TCCTGGCCGACGCTAATCTGGACAAAGTGCTGTCCGCCTACAACAAGCAC
CGGGATAAGCCCATCAGAGAGCAGGCCGAGAATATCATCCACCTGTTTAC
CCTGACCAATCTGGGAGCCCCTGCCGCCTTCAAGTACTTTGACACCACCA
TCGACCGGAAGAGGTACACCAGCACCAAAGAGGTGCTGGACGCCACCCTG
ATCCACCAGAGCATCACCGGCCTGTACGAGACACGGATCGACCTGTCTCA
GCTGGGAGGCGACagcgctGGAGGAGGTGGAAGCGGAGGAGGAGGAAGCG
GAGGAGGAGGTAGCGgacctaagaaaaagaggaaggtggcggccgct
``` pSAMca044 dCas(hel2-->P65) - amino acid (SEQ ID NO: 186)

MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD
LRLIYLALAHMIKFRGHFLIEGDLNPSGQISNQALALAPSSAPVLAQTMV
PSSAMVPLAQPPAPAPVLTPGPPQSLSAPVPKSTQAGEGTLSEALLHLQF
DADEDLGALLGNSTDPGVFTDLASVDNSEFQQLLNQGVSMSHSTAEPMLM
EYPEAITRLVTGSQRPPDPAPTPLGTSGLPNGLSGDEDFSSIADMDFSAL
LSQISSSGQRVNTEITKAPLSASMIKRYDEHHQDLTLLKALVRQQLPEKY
KEIFFDQSKNGYAGYIDGGASQEEFYKFIKPILEKMDGTEELLVKLNRED
LLRKQRTFDNGSIPHQIHLGELHAILRRQEDFYPFLKDNREKIEKILTFR
IPYYVGPLARGNSRFAWMTRKSEETITPWNFEEVVDKGASAQSFIERMTN
FDKNLPNEKVLPKHSLLYEYFTVYNELTKVKYVTEGMRKPAFLSGEQKKA
IVDLLFKTNRKVTVKQLKEDYFKKIECFDSVEISGVEDRFNASLGTYHDL
LKIIKDKDFLDNEENEDILEDIVLTLTLFEDREMIEERLKTYAHLFDDKV
MKQLKRRYTGWGRLSRKLINGIRDKQSGKTILDFLKSDGFANRNFMQLI
HDDSLTFKEDIQKAQVSGQGDSLHEHIANLAGSPAIKKGILQTVKVVDEL
VKVMGRHKPENIVIEMARENQTTQKGQKNSRERMKRIEEGIKELGSQILK
EHPVENTQLQNEKLYLYYLQNGRDMYVDQELDINRLSDYDVDAIVPQSFL
KDDSIDNKVLTRSDKNRGKSDNVPSEEVVKKMKNYWRQLLNAKLITQRKF
DNLTKAERGGLSELDKAGFIKRQLVETRQITKHVAQILDSRMNTKYDEND
KLIREVKVITLKSKLVSDFRKDFQFYKVREINNYHHAHDAYLNAVVGTAL
IKKYPKLESEFVYGDYKVYDVRKMIAKSEQEIGKATAKYFFYSNIMNFFK
TEITLANGEIRKRPLIETNGETGEIVWDKGRDFATVRKVLSMPQVNIVKK
TEVQTGGFSKESILPKRNSDKLIARKKDWDPKKYGGFDSPTVAYSVLVVA
KVEKGKSKKLKSVKELLGITIMERSSFEKNPIDFLEAKGYKEVKKDLIIK
LPKYSLFELENGRKRMLASAGELQKGNELALPSKYVNFLYLASHYEKLKG
SPEDNEQKQLFVEQHKHYLDEIIEQISEFSKRVILADANLDKVLSAYNKH
RDKPIREQAENIIHLFTLTNLGAPAAFKYFDTTIDRKRYTSTKEVLDATL
IHQSITGLYETRIDLSQLGGDSAGGGGSGGGGSGGGGSGPKKKRKVAAA pSAMca045 dCas(he12-->P65 GSlinker) - DNA
(SEQ ID NO: 187)
atgGACAAGAAGTACAGCATCGGCCTGGCCATCGGCACCAACTCTGTGGG
CTGGGCCGTGATCACCGACGAGTACAAGGTGCCCAGCAAGAAATTCAAGG
TGCTGGGCAACACCGACCGGCACAGCATCAAGAAGAACCTGATCGGAGCC
CTGCTGTTCGACAGCGGCGAAACAGCCGAGGCCACCCGGCTGAAGAGAAC
CGCCAGAAGAAGATACACCAGACGGAAGAACCGGATCTGCTATCTGCAAG
AGATCTTCAGCAACGAGATGGCCAAGGTGGACGACAGCTTCTTCCACAGA
CTGGAAGAGTCCTTCCTGGTGGAAGAGGATAAGAAGCACGAGCGGCACCC
CATCTTCGGCAACATCGTGGACGAGGTGGCCTACCACGAGAAGTACCCCA
CCATCTACCACCTGAGAAAGAAACTGGTGGACAGCACCGACAAGGCCGAC
CTGCGGCTGATCTATCTGGCCCTGGCCCACATGATCAAGTTCCGGGGCCA
CTTCCTGATCGAGGGCGACCTGAACGGCGGGGAGGCTCCGGTGGTGGGG
GCAGCGGAGGGGGGGCAGCCCTTCAGGGCAGATCAGCAACCAGGCCCTG
GCTCTGGCCCCTAGCTCCGCTCCAGTGCTGGCCCAGACTATGGTGCCCTC TAGTGCTATGGTGCCTCTGGCCCAGCCACCTGCTCCAGCCCCTGTGCTGA
CCCCAGGACCACCCCAGTCACTGAGCGCTCCAGTGCCCAAGTCTACACAG
GCCGGCGAGGGGACTCTGAGTGAAGCTCTGCTGCACCTGCAGTTCGACGC
TGATGAGGACCTGGGAGCTCTGCTGGGGAACAGCACCGATCCCGGAGTGT
TCACAGATCTGGCCTCCGTGGACAACTCTGAGTTTCAGCAGCTGCTGAAT
CAGGGCGTGTCCATGTCTCATAGTACAGCCGAACCAATGCTGATGGAGTA
CCCCGAAGCCATTACCCGGCTGGTGACCGGCAGCCAGCGGCCCCCCGACC
CCGCTCCAACTCCCCTGGGAACCAGCGGCCTGCCTAATGGGCTGTCCGGA
GATGAAGACTTCTCAAGCATCGCTGATATGGACTTTAGTGCCCTGCTGTC
ACAGATTTCCTCTAGTGGGCAGGGCGGGGAGGCTCCGGTGGTGGGGGCA
GCGGAGGGGGGGCAGCAGAGTAACACCGAGATCACCAAGGCCCCCCTG
AGCGCCTCTATGATCAAGAGATACGACGAGCACCACCAGGACCTGACCCT
GCTGAAAGCTCTCGTGCGGCAGCAGCTGCCTGAGAAGTACAAAGAGATTT
TCTTCGACCAGAGCAAGAACGGCTACGCCGGCTACATTGACGGCGGAGCC
AGCCAGGAAGAGTTCTACAAGTTCATCAAGCCCATCCTGGAAAAGATGGA
CGGCACCGAGGAACTGCTCGTGAAGCTGAACAGAGAGGACCTGCTGCGGA
AGCAGCGGACCTTCGACAACGGCAGCATCCCCCACCAGATCCACCTGGGA
GAGCTGCACGCCATTCTGCGGCGGCAGGAAGATTTTTACCCATTCCTGAA
GGACAACCGGGAAAAGATCGAGAAGATCCTGACCTTCCGCATCCCCTACT
ACGTGGGCCCTCTGGCCAGGGGAAACAGCAGATTCGCCTGGATGACCAGA
AAGAGCGAGGAAACCATCACCCCCTGGAACTTCGAGGAAGTGGTGGACAA
GGGCGCTTCCGCCCAGAGCTTCATCGAGCGGATGACCAACTTCGATAAGA
ACCTGCCCAACGAGAAGGTGCTGCCCAAGCACAGCCTGCTGTACGAGTAC
TTCACCGTGTATAACGAGCTGACCAAAGTGAAATACGTGACCGAGGGAAT
GAGAAAGCCCGCCTTCCTGAGCGGCGAGCAGAAAAAGGCCATCGTGGACC
TGCTGTTCAAGACCAACCGGAAAGTGACCGTGAAGCAGCTGAAAGAGGAC
TACTTCAAGAAAATCGAGTGCTTCGACTCCGTGGAAATCTCCGGCGTGGA
AGATCGGTTCAACGCCTCCCTGGGCACATACCACGATCTGCTGAAAATTA
TCAAGGACAAGGACTTCCTGGACAATGAGGAAAACGAGGACATTCTGGAA
GATATCGTGCTGACCCTGACACTGTTTGAGGACAGAGAGATGATCGAGGA
ACGGCTGAAAACCTATGCCCACCTGTTCGACGACAAAGTGATGAAGCAGC
TGAAGCGGCGGAGATACACCGGCTGGGGCAGGCTGAGCCGGAAGCTGATC
AACGGCATCCGGGACAAGCAGTCCGGCAAGACAATCCTGGATTTCCTGAA
GTCCGACGGCTTCGCCAACAGAAACTTCATGCAGCTGATCCACGACGACA
GCCTGACCTTTAAAGAGGACATCCAGAAAGCCCAGGTGTCCGGCCAGGGC
GATAGCCTGCACGAGCACATTGCCAATCTGGCCGGCAGCCCCGCCATTAA
GAAGGGCATCCTGCAGACAGTGAAGGTGGTGGACGAGCTCGTGAAAGTGA
TGGGCCGGCACAAGCCCGAGAACATCGTGATCGAAATGGCCAGAGAGAAC
CAGACCACCCAGAAGGGACAGAAGAACAGCCGCGAGAGAATGAAGCGGAT
CGAAGAGGGCATCAAAGAGCTGGGCAGCCAGATCCTGAAAGAACACCCCG

```
TGGAAAACACCCAGCTGCAGAACGAGAAGCTGTACCTGTACTACCTGCAG
AATGGGCGGATATGTACGTGGACCAGGAACTGGACATCAACCGGCTGTC
CGACTACGATGTGGACgcTATCGTGCCTCAGAGCTTTCTGAAGGACGACT
CCATCGACAACAAGGTGCTGACCAGAAGCGACAAGAACCGGGGCAAGAGC
GACAACGTGCCCTCCGAAGAGGTCGTGAAGAAGATGAAGAACTACTGGCG
GCAGCTGCTGAACGCCAAGCTGATTACCCAGAGAAAGTTCGACAATCTGA
CCAAGGCCGAGAGAGGCGGCCTGAGCGAACTGGATAAGGCCGGCTTCATC
AAGAGACAGCTGGTGGAAACCCGGCAGATCACAAAGCACGTGGCACAGAT
CCTGGACTCCCGGATGAACACTAAGTACGACGAGAATGACAAGCTGATCC
GGGAAGTGAAAGTGATCACCCTGAAGTCCAAGCTGGTGTCCGATTTCCGG
AAGGATTTCCAGTTTTACAAAGTGCGCGAGATCAACAACTACCACCACGC
CCACGACGCCTACCTGAACGCCGTCGTGGGAACCGCCCTGATCAAAAAGT
ACCCTAAGCTGGAAAGCGAGTTCGTGTACGGCGACTACAAGGTGTACGAC
GTGCGGAAGATGATCGCCAAGAGCGAGCAGGAAATCGGCAAGGCTACCGC
CAAGTACTTCTTCTACAGCAACATCATGAACTTTTTCAAGACCGAGATTA
CCCTGGCCAACGGCGAGATCCGGAAGCGGCCTCTGATCGAGACAAACGGC
GAAACCGGGGAGATCGTGTGGGATAAGGGCCGGGATTTTGCCACCGTGCG
GAAAGTGCTGAGCATGCCCCAAGTGAATATCGTGAAAAAGACCGAGGTGC
AGACAGGCGGCTTCAGCAAAGAGTCTATCCTGCCCAAGAGGAACAGCGAT
AAGCTGATCGCCAGAAAGAAGGACTGGGACCCTAAGAAGTACGGCGGCTT
CGACAGCCCCACCGTGGCCTATTCTGTGCTGGTGGTGGCCAAAGTGGAAA
AGGGCAAGTCCAAGAAACTGAAGAGTGTGAAAGAGCTGCTGGGGATCACC
ATCATGGAAAGAAGCAGCTTCGAGAAGAATCCCATCGACTTTCTGGAAGC
CAAGGGCTACAAAGAAGTGAAAAAGGACCTGATCATCAAGCTGCCTAAGT
ACTCCCTGTTCGAGCTGGAAAACGGCCGGAAGAGAATGCTGGCCTCTGCC
GGCGAACTGCAGAAGGGAAACGAACTGGCCCTGCCCTCCAAATATGTGAA
CTTCCTGTACCTGGCCAGCCACTATGAGAAGCTGAAGGGCTCCCCCGAGG
ATAATGAGCAGAAACAGCTGTTTGTGGAACAGCACAAGCACTACCTGGAC
GAGATCATCGAGCAGATCAGCGAGTTCTCCAAGAGAGTGATCCTGGCCGA
CGCTAATCTGGACAAAGTGCTGTCCGCCTACAACAAGCACCGGGATAAGC
CCATCAGAGAGCAGGCCGAGAATATCATCCACCTGTTTACCCTGACCAAT
CTGGGAGCCCCTGCCGCCTTCAAGTACTTTGACACCACCATCGACCGGAA
GAGGTACACCAGCACCAAAGAGGTGCTGGACGCCACCCTGATCCACCAGA
GCATCACCGGCCTGTACGAGACACGGATCGACCTGTCTCAGCTGGGAGGC
GACagcgctGGAGGAGGTGGAAGCGGAGGAGGAGGAAGCGGAGGAGGAGG
TAGCggacctaagaaaaagaggaaggtggcggccgct
pSAMca045 dCas(hel2-->P65 GSlinker) - amino acid
                                (SEQ ID NO: 188)
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKPTIYHLRKKLVDSTDKAD
LRLIYLALAHMIKFRGHFLIEGDLNGGGGSGGGGSGGGGSPSGQISNQAL
ALAPSSAPVLAQTMVPSSAMVPLAQPPAPAPVLTPGPPQSLSAPVPKSTQ
AGEGTLSEALLHLQFDADEDLGALLGNSTDPGVFTDLASVDNSEFQQLLN
QGVSMSHSTAEPMLMEYPEAITRLVTGSQRPPDPAPTPLGTSGLPNGLSG
DEDFSSIADMDFSALLSQISSSGQGGGGSGGGGSGGGGSRVNTEITKAPL
SASMIKRYDEHHQDLTLLKALVRQQLPEKYKEIFFDQSKNGYAGYIDGGA
SQEEFYKFIKPILEKMDGTEELLVKLNREDLLRKQRTFDNGSIPHQIHLG
ELHAILRRQEDFYPFLKDNREKIEKILTFRIPYYVGPLARGNSRFAWMTR
KSEETITPWNFEEVVDKGASAQSFIERMTNFDKNLPNEKVLPKHSLLYEY
FTVYNELTKVKYVTEGMRKPAFLSGEQKKAIVDLLFKTNRKVTVKQLKED
YFKKIECFDSVEISGVEDRFNASLGTYHDLLKIIKDKDFLDNEENEDILE
DIVLTLTLFEDREMIEERLKTYAHLFDDKVMKQLKRRRYTGWGRLSRKLI
NGIRDKQSGKTILDFLKSDGFANRNFMQLIHDDSLTFKEDIQKAQVSGQG
DSLHEHIANLAGSPAIKKGILQTVKVVDELVKVMGRHKPENIVIEMAREN
QTTQKGQKNSRERMKRIEEGIKELGSQILKEHPVENTQLQNEKLYLYYLQ
NGRDMYVDQELDINRLSDYDVDAIVPQSFLKDDSIDNKVLTRSDKNRGKS
DNVPSEEVVKKMKNYWRQLLNAKLITQRKFDNLTKAERGGLSELDKAGFI
KRQLVETRQITKHVAQILDSRMNTKYDENDKLIREVKVITLKSKLVSDFR
KDFQFYKVREINNYHHAHDAYLNAVVGTALIKKYPKLESEFVYGDYKVYD
VRKMIAKSEQEIGKATAKYFFYSNIMNFFKTEITLANGEIRKRPLIETNG
ETGEIVWDKGRDFATVRKVLSMPQVNIVKKTEVQTGGFSKESILPKRNSD
KLIARKKDWDPKKYGGFDSPTVAYSVLVVAKVEKGKSKKLKSVKELLGIT
IMERSSFEKNPIDFLEAKGYKEVKKDLIIKLPKYSLFELENGRKRMLASA
GELQKGNELALPSKYVNFLYLASHYEKLKGSPEDNEQKQLFVEQHKHYLD
EIIEQISEFSKRVILADANLDKVLSAYNKHRDKPIREQAENIIHLFTLTN
LGAPAAFKYFDTTIDRKRYTSTKEVLDATLIHQSITGLYETRIDLSQLGG
DSAGGGGSGGGGSGGGGSGPKKKRKVAAA
```

Replacing the HNH domain with a transcriptional effector domain

```
pSAMca050 dCas9(HNH-->vp64, 3XGS) - DNA
                                (SEQ ID NO: 189)
atgGACAAGAAGTACAGCATCGGCCTGGCCATCGGCACCAACTCTGTGGG
CTGGGCCGTGATCACCGACGAGTACAAGGTGCCCAGCAAGAAATTCAAGG
TGCTGGGCAACACCGACCGGCACAGCATCAAGAAGAACCTGATCGGAGCC
CTGCTGTTCGACAGCGGCGAAACAGCCGAGGCCACCCGGCTGAAGAGAAC
CGCCAGAAGAAGATACACCAGACGGAAGAACCGGATCTGCTATCTGCAAG
AGATCTTCAGCAACGAGATGGCCAAGGTGGACGACAGCTTCTTCCACAGA
CTGGAAGAGTCCTTCCTGGTGGAAGAGGATAAGAAGCACGAGCGGCACCC
CATCTTCGGCAACATCGTGGACGAGGTGGCCTACCACGAGAAGTACCCCA
CCATCTACCACCTGAGAAAGAAACTGGTGGACAGCACCGACAAGGCCGAC
CTGCGGCTGATCTATCTGGCCCTGGCCCACATGATCAAGTTCCGGGGCCA
CTTCCTGATCGAGGGCGACCTGAACCCCGACAACAGCGACGTGGACAAGC
```

-continued

TGTTCATCCAGCTGGTGCAGACCTACAACCAGCTGTTCGAGGAAAACCCC
ATCAACGCCAGCGGCGTGGACGCCAAGGCCATCCTGTCTGCCAGACTGAG
CAAGAGCAGACGGCTGGAAAATCTGATCGCCCAGCTGCCCGGCGAGAAGA
AGAATGGCCTGTTCGGCAACCTGATTGCCCTGAGCCTGGGCCTGACCCCC
AACTTCAAGAGCAACTTCGACCTGGCCGAGGATGCCAAACTGCAGCTGAG
CAAGGACACCTACGACGACGACCTGGACAACCTGCTGGCCCAGATCGGCG
ACCAGTACGCCGACCTGTTTCTGGCCGCCAAGAACCTGTCCGACGCCATC
CTGCTGAGCGACATCCTGAGAGTGAACACCGAGATCACCAAGGCCCCCCT
GAGCGCCTCTATGATCAAGAGATACGACGAGCACCACCAGGACCTGACCC
TGCTGAAAGCTCTCGTGCGGCAGCAGCTGCCTGAGAAGTACAAAGAGATT
TTCTTCGACCAGAGCAAGAACGGCTACGCCGGCTACATTGACGGCGGAGC
CAGCCAGGAAGAGTTCTACAAGTTCATCAAGCCCATCCTGGAAAAGATGG
ACGGCACCGAGGAACTGCTCGTGAAGCTGAACAGAGAGGACCTGCTGCGG
AAGCAGCGGACCTTCGACAACGGCAGCATCCCCCACCAGATCCACCTGGG
AGAGCTGCACGCCATTCTGCGGCGGCAGGAAGATTTTTACCCATTCCTGA
AGGACAACCGGGAAAAGATCGAGAAGATCCTGACCTTCCGCATCCCCTAC
TACGTGGGCCCTCTGGCCAGGGGAAACAGCAGATTCGCCTGGATGACCAG
AAAGAGCGAGGAAACCATCACCCCCTGGAACTTCGAGGAAGTGGTGGACA
AGGGCGCTTCCGCCCAGAGCTTCATCGAGCGGATGACCAACTTCGATAAG
AACCTGCCCAACGAGAAGGTGCTGCCCAAGCACAGCCTGCTGTACGAGTA
CTTCACCGTGTATAACGAGCTGACCAAAGTGAAATACGTGACCGAGGGAA
TGAGAAAGCCCGCCTTCCTGAGCGGCGAGCAGAAAAAGGCCATCGTGGAC
CTGCTGTTCAAGACCAACCGGAAAGTGACCGTGAAGCAGCTGAAAGAGGA
CTACTTCAAGAAAATCGAGTGCTTCGACTCCGTGGAAATCTCCGGCGTGG
AAGATCGGTTCAACGCCTCCCTGGGCACATACCACGATCTGCTGAAAATT
ATCAAGGACAAGGACTTCCTGGACAATGAGGAAAACGAGGACATTCTGGA
AGATATCGTGCTGACCCTGACACTGTTTGAGGACAGAGAGATGATCGAGG
AACGGCTGAAAACCTATGCCCACCTGTTCGACGACAAAGTGATGAAGCAG
CTGAAGCGGCGGAGATACACCGGCTGGGGCAGGCTGAGCCGGAAGCTGAT
CAACGGCATCCGGGACAAGCAGTCCGGCAAGACAATCCTGGATTTCCTGA
AGTCCGACGGCTTCGCCAACAGAAACTTCATGCAGCTGATCCACGACGAC
AGCCTGACCTTTAAAGAGGACATCCAGAAAGCCCAGGTGTCCGGCCAGGG
CGATAGCCTGCACGAGCACATTGCCAATCTGGCCGGCAGCCCCGCCATTA
AGAAGGGCATCCTGCAGACAGTGAAGGTGGTGGACGAGCTCGTGAAAGTG
ATGGGCCGGCACAAGCCCGAGAACATCGTGATCGAAATGGCCAGAGAGAA
CCAGACCACCCAGAAGGGACAGAAGGGCGGGGAGGCTCCGGTGGTGGGG
GCAGCGGAGGGGGGGCAGCGGACGGGCTGACGCATTGGACGATTTTGAT
CTGGATATGCTGGGAAGTGACGCCCTCGATGATTTTGACCTTGACATGCT
TGGTTCGGATGCCCTTGATGACTTTGACCTCGACATGCTCGGCAGTGACG
CCCTTGATGATTTCGACCTGGACATGCTGATTAACGGCGGGGAGGCTCC

-continued

GGTGGTGGGGGCAGCGGAGGGGGGGCAGCACCAAGGCCGAGAGAGGCGG
CCTGAGCGAACTGGATAAGGCCGGCTTCATCAAGAGACAGCTGGTGGAAA
CCCGGCAGATCACAAAGCACGTGGCACAGATCCTGGACTCCCGGATGAAC
ACTAAGTACGACGAGAATGACAAGCTGATCCGGGAAGTGAAAGTGATCAC
CCTGAAGTCCAAGCTGGTGTCCGATTTCCGGAAGGATTTCCAGTTTTACA
AAGTGCGCGAGATCAACAACTACCACCACGCCCACGACGCCTACCTGAAC
GCCGTCGTGGGAACCGCCCTGATCAAAAAGTACCCTAAGCTGGAAAGCGA
GTTCGTGTACGGCGACTACAAGGTGTACGACGTGCGCAAGATGATCGCCA
AGAGCGAGCAGGAAATCGGCAAGGCTACCGCCAAGTACTTCTTCTACAGC
AACATCATGAACTTTTTCAAGACCGAGATTACCCTGGCCAACGGCGAGAT
CCGGAAGCGGCCTCTGATCGAGACAAACGGCGAAACCGGGGAGATCGTGT
GGGATAAGGGCCGGGATTTTGCCACCGTGCGGAAAGTGCTGAGCATGCCC
CAAGTGAATATCGTGAAAAAGACCGAGGTGCAGACAGGCGGCTTCAGCAA
AGAGTCTATCCTGCCCAAGAGGAACAGCGATAAGCTGATCGCCAGAAAGA
AGGACTGGGACCCTAAGAAGTACGGCGGCTTCGACAGCCCCACCGTGGCC
TATTCTGTGCTGGTGGTGGCCAAAGTGGAAAAGGGCAAGTCCAAGAAACT
GAAGAGTGTGAAAGAGCTGCTGGGGATCACCATCATGGAAAGAAGCAGCT
TCGAGAAGAATCCCATCGACTTTCTGGAAGCCAAGGGCTACAAAGAAGTG
AAAAAGGACCTGATCATCAAGCTGCCTAAGTACTCCCTGTTCGAGCTGGA
AAACGGCCGGAAGAGAATGCTGGCCTCTGCCGGCGAACTGCAGAAGGGAA
ACGAACTGGCCCTGCCCTCCAAATATGTGAACTTCCTGTACCTGGCCAGC
CACTATGAGAAGCTGAAGGGCTCCCCCGAGGATAATGAGCAGAAACAGCT
GTTTGTGGAACAGCACAAGCACTACCTGGACGAGATCATCGAGCAGATCA
GCGAGTTCTCCAAGAGAGTGATCCTGGCCGACGCTAATCTGGACAAAGTG
CTGTCCGCCTACAACAAGCACCGGGATAAGCCCATCAGAGAGCAGGCCGA
GAATATCATCCACCTGTTTACCCTGACCAATCTGGGAGCCCCTGCCGCCT
TCAAGTACTTTGACACCACCATCGACCGGAAGAGGTACACCAGCACCAAA
GAGGTGCTGGACGCCACCCTGATCCACCAGAGCATCACCGGCCTGTACGA
GACACGGATCGACCTGTCTCAGCTGGGAGGCGACagcgctGGAGGAGGTG
GAAGCGGAGGAGGAGGAAGCGGAGGAGGAGGTAGCggacctaagaaaaag
aggaaggtggcggccgct pSAMca050 dCas9(HNH-->vp64, 3XGS) - AA
(SEQ ID NO: 190)
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKGGGGSGGGGSGGGGSGRADALDDFD

LDMLGSDALDDFDLDMLGSDALDDFDLDMLGSDALDDFDLDMLINGGGGS

GGGGSGGGGSTKAERGGLSELDKAGFIKRQLVETRQITKHVAQILDSRMN

TKYDENDKLIREVKVITLKSKLVSDFRKDFQFYKVREINNYHHAHDAYLN

AVVGTALIKKYPKLESEFVYGDYKVYDVRKMIAKSEQEIGKATAKYFFYS

NIMNFFKTEITLANGEIRKRPLIETNGETGEIVWDKGRDFATVRKVLSMP

QVNIVKKTEVQTGGFSKESILPKRNSDKLIARKKDWDPKKYGGFDSPTVA

YSVLVVAKVEKGKSKKLKSVKELLGITIMERSSFEKNPIDFLEAKGYKEV

KKDLIIKLPKYSLFELENGRKRMLASAGELQKGNELALPSKYVNFLYLAS

HYEKLKGSPEDNEQKQLFVEQHKHYLDEIIEQISEFSKRVILADANLDKV

LSAYNKHRDKPIREQAENIIHLFTLTNLGAPAAFKYFDTTIDRKRYTSTK

EVLDATLIHQSITGLYETRIDLSQLGGDSAGGGGSGGGGSGGGGSGPKKK

RKVAAA pSAMca051 dCas9(HNH-->vp64, 6XGS) - DNA
(SEQ ID NO: 191)
AAGAAGTACAGCATCGGCCTGGCCATCGGCACCAACTCTGTGGGCTGGGC

CGTGATCACCGACGAGTACAAGGTGCCCAGCAAGAAATTCAAGGTGCTGG

GCAACACCGACCGGCACAGCATCAAGAAGAACCTGATCGGAGCCCTGCTG

TTCGACAGCGGCGAAACAGCCGAGGCCACCCGGCTGAAGAGAACCGCCAG

AAGAAGATACACCAGACGGAAGAACCGGATCTGCTATCTGCAAGAGATCT

TCAGCAACGAGATGGCCAAGGTGGACGACAGCTTCTTCCACAGACTGGAA

GAGTCCTTCCTGGTGGAAGAGGATAAGAAGCACGAGCGGCACCCCATCTT

CGGCAACATCGTGGACGAGGTGGCCTACCACGAGAAGTACCCCACCATCT

ACCACCTGAGAAAGAAACTGGTGGACAGCACCGACAAGGCCGACCTGCGG

CTGATCTATCTGGCCCTGGCCCACATGATCAAGTTCCGGGGCCACTTCCT

GATCGAGGGCGACCTGAACCCCGACAACAGCGACGTGGACAAGCTGTTCA

TCCAGCTGGTGCAGACCTACAACCAGCTGTTCGAGGAAAACCCCATCAAC

GCCAGCGGCGTGGACGCCAAGGCCATCCTGTCTGCCAGACTGAGCAAGAG

CAGACGGCTGGAAAATCTGATCGCCCAGCTGCCCGGCGAGAAGAAGAATG

GCCTGTTCGGCAACCTGATTGCCCTGAGCCTGGGCCTGACCCCCAACTTC

AAGAGCAACTTCGACCTGGCCGAGGATGCCAAACTGCAGCTGAGCAAGGA

CACCTACGACGACGACCTGGACAACCTGCTGGCCCAGATCGGCGACCAGT

ACGCCGACCTGTTTCTGGCCGCCAAGAACCTGTCCGACGCCATCCTGCTG

AGCGACATCCTGAGAGTGAACACCGAGATCACCAAGGCCCCCCTGAGCGC

CTCTATGATCAAGAGATACGACGAGCACCACCAGGACCTGACCCTGCTGA

AAGCTCTCGTGCGGCAGCAGCTGCCTGAGAAGTACAAAGAGATTTTCTTC

GACCAGAGCAAGAACGGCTACGCCGGCTACATTGACGGCGGAGCCAGCCA

GGAAGAGTTCTACAAGTTCATCAAGCCCATCCTGGAAAAGATGGACGGCA

CCGAGGAACTGCTCGTGAAGCTGAACAGAGAGGACCTGCTGCGGAAGCAG

CGGACCTTCGACAACGGCAGCATCCCCCACCAGATCCACCTGGGAGAGCT

GCACGCCATTCTGCGGCGGCAGGAAGATTTTTACCCATTCCTGAAGGACA

ACCGGGAAAAGATCGAGAAGATCCTGACCTTCCGCATCCCCTACTACGTG

GGCCCTCTGGCCAGGGGAAACAGCAGATTCGCCTGGATGACCAGAAAGAG

CGAGGAAACCATCACCCCCTGGAACTTCGAGGAAGTGGTGGACAAGGGCG

CTTCCGCCCAGAGCTTCATCGAGCGGATGACCAACTTCGATAAGAACCTG

CCCAACGAGAAGGTGCTGCCCAAGCACAGCCTGCTGTACGAGTACTTCAC

CGTGTATAACGAGCTGACCAAAGTGAAATACGTGACCGAGGGAATGAGAA

AGCCCGCCTTCCTGAGCGGCGAGCAGAAAAAGGCCATCGTGGACCTGCTG

TTCAAGACCAACCGGAAAGTGACCGTGAAGCAGCTGAAAGAGGACTACTT

CAAGAAAATCGAGTGCTTCGACTCCGTGGAAATCTCCGGCGTGGAAGATC

GGTTCAACGCCTCCCTGGGCACATACCACGATCTGCTGAAAATTATCAAG

GACAAGGACTTCCTGGACAATGAGGAAAACGAGGACATTCTGGAAGATAT

CGTGCTGACCCTGACACTGTTTGAGGACAGAGAGATGATCGAGGAACGGC

TGAAAACCTATGCCCACCTGTTCGACGACAAAGTGATGAAGCAGCTGAAG

CGGCGGAGATACACCGGCTGGGGCAGGCTGAGCCGGAAGCTGATCAACGG

CATCCGGGACAAGCAGTCCGGCAAGACAATCCTGGATTTCCTGAAGTCCG

ACGGCTTCGCCAACAGAAACTTCATGCAGCTGATCCACGACGACAGCCTG

ACCTTTAAAGAGGACATCCAGAAAGCCCAGGTGTCCGGCCAGGGCGATAG

CCTGCACGAGCACATTGCCAATCTGGCCGGCAGCCCCGCCATTAAGAAGG

GCATCCTGCAGACAGTGAAGGTGGTGGACGAGCTCGTGAAAGTGATGGGC

CGGCACAAGCCCGAGAACATCGTGATCGAAATGGCCAGAGAGAACCAGAC

CACCCAGAAGGGACAGAAGGGGGGTGGTGGAAGTGGCGGTGGCGGCTCCG

GAGGAGGAGGAAGCGGCGGCGGTGGTAGTGGCGGCGGCGGAAGCGGAGGC

GGCGGCTCCGGACGGGCTGACGCATTGGACGATTTTGATCTGGATATGCT

GGGAAGTGACGCCCTCGATGATTTTGACCTTGACATGCTTGGTTCGGATG

CCCTTGATGACTTTGACCTCGACATGCTCGGCAGTGACGCCCTTGATGAT

TTCGACCTGGACATGCTGATTAACGGGGGTGGTGGAAGTGGCGGTGGCGG

CTCCGGAGGAGGAGGAAGCGGCGGCGGTGGTAGTGGCGGCGGCGGAAGCG

GAGGCGGCGGCTCCACCAAGGCCGAGAGAGGCGGCCTGAGCGAACTGGAT

AAGGCCGGCTTCATCAAGAGACAGCTGGTGGAAACCCGGCAGATCACAAA

GCACGTGGCACAGATCCTGGACTCCCGGATGAACACTAAGTACGACGAGA

ATGACAAGCTGATCCGGGAAGTGAAAGTGATCACCCTGAAGTCCAAGCTG

GTGTCCGATTTCCGGAAGGATTTCCAGTTTTACAAAGTGCGCGAGATCAA

CAACTACCACCACGCCCACGACGCCTACCTGAACGCCGTCGTGGGAACCG

CCCTGATCAAAAAGTACCCTAAGCTGGAAAGCGAGTTCGTGTACGGCGAC

TACAAGGTGTACGACGTGCGGAAGATGATCGCCAAGAGCGAGCAGGAAAT

```
CGGCAAGGCTACCGCCAAGTACTTCTTCTACAGCAACATCATGAACTTTT

TCAAGACCGAGATTACCCTGGCCAACGGCGAGATCCGGAAGCGGCCTCTG

ATCGAGACAAACGGCGAAACCGGGGAGATCGTGTGGGATAAGGGCCGGGA

TTTTGCCACCGTGCGGAAAGTGCTGAGCATGCCCCAAGTGAATATCGTGA

AAAAGACCGAGGTGCAGACAGGCGGCTTCAGCAAAGAGTCTATCCTGCCC

AAGAGGAACAGCGATAAGCTGATCGCCAGAAAGAAGGACTGGGACCCTAA

GAAGTACGGCGGCTTCGACAGCCCCACCGTGGCCTATTCTGTGCTGGTGG

TGGCCAAAGTGGAAAAGGGCAAGTCCAAGAAACTGAAGAGTGTGAAAGAG

CTGCTGGGGATCACCATCATGGAAAGAAGCAGCTTCGAGAAGAATCCCAT

CGACTTTCTGGAAGCCAAGGGCTACAAAGAAGTGAAAAAGGACCTGATCA

TCAAGCTGCCTAAGTACTCCCTGTTCGAGCTGGAAAACGGCCGGAAGAGA

ATGCTGGCCTCTGCCGGCGAACTGCAGAAGGGAAACGAACTGGCCCTGCC

CTCCAAATATGTGAACTTCCTGTACCTGGCCAGCCACTATGAGAAGCTGA

AGGGCTCCCCCGAGGATAATGAGCAGAAACAGCTGTTTGTGGAACAGCAC

AAGCACTACCTGGACGAGATCATCGAGCAGATCAGCGAGTTCTCCAAGAG

AGTGATCCTGGCCGACGCTAATCTGGACAAAGTGCTGTCCGCCTACAACA

AGCACCGGGATAAGCCCATCAGAGAGCAGGCCGAGAATATCATCCACCTG

TTTACCCTGACCAATCTGGGAGCCCCTGCCGCCTTCAAGTACTTTGACAC

CACCATCGACCGGAAGAGGTACACCAGCACCAAGGAGGTGCTGGACGCCA

CCCTGATCCACCAGAGCATCACCGGCCTGTACGAGACACGGATCGACCTG

TCTCAGCTGGGAGGCGACagcgctGGAGGAGGTGGAAGCGGAGGAGGAGG

AAGCGGAGGAGGAGGTAGCGgacctaagaaaaagaggaaggtggcggccg ctgctagcGGCAG pSAMca051 dCas9(HNH-->vp64, 6XGS) - AA
                                    (SEQ ID NO: 192)
KKYSIGLAIGTNSVGWAVITDEYKVPSKKFKVLGNTDRHSIKKNLIGALL

FDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPIN

ASGVDAKAILSARLSKSRRLENLIAQLPGEKKNGLFGNLIALSLGLTPNF

KSNFDLAEDAKLQLSKDTYDDDLDNLLAQIGDQYADLFLAAKNLSDAILL

SDILRVNTEITKAPLSASMIKRYDEHHQDLTLLKALVRQQLPEKYKEIFF

DQSKNGYAGYIDGGASQEEFYKFIKPILEKMDGTEELLVKLNREDLLRKQ

RTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLL

FKTNRKVTVKQLKEDYFKKIECFDSVEISGVEDRFNASLGTYHDLLKIIK

DKDFLDNEENEDILEDIVLTLTLFEDREMIEERLKTYAHLFDDKVMKQLK

RRRYTGWGRLSRKLINGIRDKQSGKTILDFLKSDGFANRNFMQLIHDDSL

TFKEDIQKAQVSGQGDSLHEHIANLAGSPAIKKGILQTVKVVDELVKVMG

RHKPENIVIEMARENQTTQKGQKGGGGSGGGGSGGGGSGGGGSGGGGSGG

GGSGRADALDDFDLDMLGSDALDDFDLDMLGSDALDDFDLDMLGSDALDD

FDLDMLINGGGGSGGGGSGGGGSGGGGSGGGGSGGGGSTKAERGGLSELD

KAGFIKRQLVETRQITKHVAQILDSRMNTKYDENDKLIREVKVITLKSKL

VSDFRKDFQFYKVREINNYHHAHDAYLNAVVGTALIKKYPKLESEFVYGD

YKVYDVRKMIAKSEQEIGKATAKYFFYSNIMNFFKTEITLANGEIRKRPL

IETNGETGEIVWDKGRDFATVRKVLSMPQVNIVKKTEVQTGGFSKESILP

KRNSDKLIARKKDWDPKKYGGFDSPTVAYSVLVVAKVEKGKSKKLKSVKE

LLGITIMERSSFEKNPIDFLEAKGYKEVKKDLIIKLPKYSLFELENGRKR

MLASAGELQKGNELALPSKYVNFLYLASHYEKLKGSPEDNEQKQLFVEQH

KHYLDEIIEQISEFSKRVILADANLDKVLSAYNKHRDKPIREQAENIIHL

FTLTNLGAPAAFKYFDTTIDRKRYTSTKEVLDATLIHQSITGLYETRIDL

SQLGGDSAGGGGSGGGGSGGGGSGPKKKRKVAAAASG pSAMca052 dCas9(HNH-->P65, 3XGS) - DNA
                                    (SEQ ID NO: 193)
GACAAGAAGTACAGCATCGGCCTGGCCATCGGCACCAACTCTGTGGGCTG

GGCCGTGATCACCGACGAGTACAAGGTGCCCAGCAAGAAATTCAAGGTGC

TGGGCAACACCGACCGGCACAGCATCAAGAAGAACCTGATCGGAGCCCTG

CTGTTCGACAGCGGCGAAACAGCCGAGGCCACCCGGCTGAAGAGAACCGC

CAGAAGAAGATACACCAGACGGAAGAACCGGATCTGCTATCTGCAAGAGA

TCTTCAGCAACGAGATGGCCAAGGTGGACGACAGCTTCTTCCACAGACTG

GAAGAGTCCTTCCTGGTGGAAGAGGATAAGAAGCACGAGCGGCACCCCAT

CTTCGGCAACATCGTGGACGAGGTGGCCTACCACGAGAAGTACCCCACCA

TCTACCACCTGAGAAAGAAACTGGTGGACAGCACCGACAAGGCCGACCTG

CGGCTGATCTATCTGGCCCTGGCCCACATGATCAAGTTCCGGGGCCACTT

CCTGATCGAGGGCGACCTGAACCCCGACAACAGCGACGTGGACAAGCTGT

TCATCCAGCTGGTGCAGACCTACAACCAGCTGTTCGAGGAAAACCCCATC

AACGCCAGCGGCGTGGACGCCAAGGCCATCCTGTCTGCCAGACTGAGCAA

GAGCAGACGGCTGGAAAATCTGATCGCCCAGCTGCCCGGCGAGAAGAAGA

ATGGCCTGTTCGGCAACCTGATTGCCCTGAGCCTGGGCCTGACCCCCAAC

TTCAAGAGCAACTTCGACCTGGCCGAGGATGCCAAACTGCAGCTGAGCAA

GGACACCTACGACGACGACCTGGACAACCTGCTGGCCCAGATCGGCGACC

AGTACGCCGACCTGTTTCTGGCCGCCAAGAACCTGTCCGACGCCATCCTG

CTGAGCGACATCCTGAGAGTGAACACCGAGATCACCAAGGCCCCCCTGAG

CGCCTCTATGATCAAGAGATACGACGAGCACCACCAGGACCTGACCCTGC

TGAAAGCTCTCGTGCGGCAGCAGCTGCCTGAGAAGTACAAAGAGATTTTC

TTCGACCAGAGCAAGAACGGCTACGCCGGCTACATTGACGGCGGAGCCAG

CCAGGAAGAGTTCTACAAGTTCATCAAGCCCATCCTGGAAAAGATGGACG

GCACCGAGGAACTGCTCGTGAAGCTGAACAGAGAGGACCTGCTGCGGAAG

CAGCGGACCTTCGACAACGGCAGCATCCCCCACCAGATCCACCTGGGAGA

GCTGCACGCCATTCTGCGGCGGCAGGAAGATTTTTACCCATTCCTGAAGG

ACAACCGGGAAAAGATCGAGAAGATCCTGACCTTCCGCATCCCCTACTAC

GTGGGCCCTCTGGCCAGGGGAAACAGCAGATTCGCCTGGATGACCAGAAA
```

```
GAGCGAGGAAACCATCACCCCCTGGAACTTCGAGGAAGTGGTGGACAAGG
GCGCTTCCGCCCAGAGCTTCATCGAGCGGATGACCAACTTCGATAAGAAC
CTGCCCAACGAGAAGGTGCTGCCCAAGCACAGCCTGCTGTACGAGTACTT
CACCGTGTATAACGAGCTGACCAAAGTGAAATACGTGACCGAGGGAATGA
GAAAGCCCGCCTTCCTGAGCGGCGAGCAGAAAAAGGCCATCGTGGACCTG
CTGTTCAAGACCAACCGGAAAGTGACCGTGAAGCAGCTGAAAGAGGACTA
CTTCAAGAAAATCGAGTGCTTCGACTCCGTGGAAATCTCCGGCGTGGAAG
ATCGGTTCAACGCCTCCCTGGGCACATACCACGATCTGCTGAAAATTATC
AAGGACAAGGACTTCCTGGACAATGAGGAAAACGAGGACATTCTGGAAGA
TATCGTGCTGACCCTGACACTGTTTGAGGACAGAGAGATGATCGAGGAAC
GGCTGAAAACCTATGCCCACCTGTTCGACGACAAAGTGATGAAGCAGCTG
AAGCGGCGGAGATACACCGGCTGGGGCAGGCTGAGCCGGAAGCTGATCAA
CGGCATCCGGGACAAGCAGTCCGGCAAGACAATCCTGGATTTCCTGAAGT
CCGACGGCTTCGCCAACAGAAACTTCATGCAGCTGATCCACGACGACAGC
CTGACCTTTAAAGAGGACATCCAGAAAGCCCAGGTGTCCGGCCAGGGCGA
TAGCCTGCACGAGCACATTGCCAATCTGGCCGGCAGCCCCGCCATTAAGA
AGGGCATCCTGCAGACAGTGAAGGTGGTGGACGAGCTCGTGAAAGTGATG
GGCCGGCACAAGCCCGAGAACATCGTGATCGAAATGGCCAGAGAGAACCA
GACCACCCAGAAGGGACAGAAGGGCGGGGGAGGCTCCGGTGGTGGGGCA
GCGGAGGGGGGGCAGCCCTTCAGGGCAGATCAGCAACCAGGCCCTGGCT
CTGGCCCCTAGCTCCGCTCCAGTGCTGGCCCAGACTATGGTGCCCTCTAG
TGCTATGGTGCCTCTGGCCCAGCCACCTGCTCCAGCCCCTGTGCTGACCC
CAGGACCACCCCAGTCACTGAGCGCTCCAGTGCCCAAGTCTACACAGGCC
GGCGAGGGGACTCTGAGTGAAGCTCTGCTGCACCTGCAGTTCGACGCTGA
TGAGGACCTGGGAGCTCTGCTGGGGAACAGCACCGATCCCGGAGTGTTCA
CAGATCTGGCCTCCGTGGACAACTCTGAGTTTCAGCAGCTGCTGAATCAG
GGCGTGTCCATGTCTCATAGTACAGCCGAACCAATGCTGATGGAGTACCC
CGAAGCCATTACCCGGCTGGTGACCGGCAGCCAGCGGCCCCCCGACCCCG
CTCCAACTCCCCTGGGAACCAGCGGCCTGCCTAATGGGCTGTCCGGAGAT
GAAGACTTCTCAAGCATCGCTGATATGGACTTTAGTGCCCTGCTGTCACA
GATTTCCTCTAGTGGGCAGGGCGGGGAGGCTCCGGTGGTGGGGGCAGCG
GAGGGGGGGGCAGCACCAAGGCCGAGAGAGGCGGCCTGAGCGAACTGGAT
AAGGCCGGCTTCATCAAGAGACAGCTGGTGGAAACCCGGCAGATCACAAA
GCACGTGGCACAGATCCTGGACTCCCGGATGAACACTAAGTACGACGAGA
ATGACAAGCTGATCCGGGAAGTGAAAGTGATCACCCTGAAGTCCAAGCTG
GTGTCCGATTTCCGGAAGGATTTCCAGTTTTACAAAGTGCGCGAGATCAA
CAACTACCACCACGCCCACGACGCCTACCTGAACGCCGTCGTGGGAACCG
CCCTGATCAAAAAGTACCCTAAGCTGGAAAGCGAGTTCGTGTACGGCGAC
TACAAGGTGTACGACGTGCGGAAGATGATCGCCAAGAGCGAGCAGGAAAT
CGGCAAGGCTACCGCCAAGTACTTCTTCTACAGCAACATCATGAACTTTT
```

```
TCAAGACCGAGATTACCCTGGCCAACGGCGAGATCCGGAAGCGGCCTCTG
ATCGAGACAAACGGCGAAACCGGGGAGATCGTGTGGGATAAGGGCCGGGA
TTTTGCCACCGTGCGGAAAGTGCTGAGCATGCCCCAAGTGAATATCGTGA
AAAAGACCGAGGTGCAGACAGGCGGCTTCAGCAAAGAGTCTATCCTGCCC
AAGAGGAACAGCGATAAGCTGATCGCCAGAAAGAAGGACTGGGACCCTAA
GAAGTACGGCGGCTTCGACAGCCCCACCGTGGCCTATTCTGTGCTGGTGG
TGGCCAAAGTGGAAAAGGGCAAGTCCAAGAAACTGAAGAGTGTGAAAGAG
CTGCTGGGGATCACCATCATGGAAAGAAGCAGCTTCGAGAAGAATCCCAT
CGACTTTCTGGAAGCCAAGGGCTACAAAGAAGTGAAAAAGGACCTGATCA
TCAAGCTGCCTAAGTACTCCCTGTTCGAGCTGGAAAACGGCCGGAAGAGA
ATGCTGGCCTCTGCCGGCGAACTGCAGAAGGGAAACGAACTGGCCCTGCC
CTCCAAATATGTGAACTTCCTGTACCTGGCCAGCCACTATGAGAAGCTGA
AGGGCTCCCCCGAGGATAATGAGCAGAAACAGCTGTTTGTGGAACAGCAC
AAGCACTACCTGGACGAGATCATCGAGCAGATCAGCGAGTTCTCCAAGAG
AGTGATCCTGGCCGACGCTAATCTGGACAAAGTGCTGTCCGCCTACAACA
AGCACCGGGATAAGCCCATCAGAGAGCAGGCCGAGAATATCATCCACCTG
TTTACCCTGACCAATCTGGGAGCCCCTGCCGCCTTCAAGTACTTTGACAC
CACCATCGACCGGAAGAGGTACACCAGCACCAAAGAGGTGCTGGACGCCA
CCCTGATCCACCAGAGCATCACCGGCCTGTACGAGACACGGATCGACCTG
TCTCAGCTGGGAGGCGAC
``` pSAMca052 dCas9(HNH-->P65, 3XGS) - AA
(SEQ ID NO: 194)
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFDSVEISGVEDRFNASLGTYHDLLKII
KDKDFLDNEENEDILEDIVLTLTLFEDREMIEERLKTYAHLFDDKVMKQL
KRRRYTGWGRLSRKLINGIRDKQSGKTILDFLKSDGFANRNFMQLIHDDS
LTFKEDIQKAQVSGQGDSLHEHIANLAGSPAIKKGILQTVKVVDELVKVM
GRHKPENIVIEMARENQTTQKGQKGGGGSGGGGSGGGGSPSGQISNQALA
LAPSSAPVLAQTMVPSSAMVPLAQPPAPAPVLTPGPPQSLSAPVPKSTQA
GEGTLSEALLHLQFDADEDLGALLGNSTDPGVFTDLASVDNSEFQQLLNQ
GVSMSHSTAEPMLMEYPEAITRLVTGSQRPPDPAPTPLGTSGLPNGLSGD
EDFSSIADMDFSALLSQISSSGQGGGGSGGGGSGGGGSTKAERGGLSELD

-continued

KAGFIKRQLVETRQITKHVAQILDSRMNTKYDENDKLIREVKVITLKSKL

VSDFRKDFQFYKVREINNYHHAHDAYLNAVVGTALIKKYPKLESEFVYGD

YKVYDVRKMIAKSEQEIGKATAKYFFYSNIMNFFKTEITLANGEIRKRPL

IETNGETGEIVWDKGRDFATVRKVLSMPQVNIVKKTEVQTGGFSKESILP

KRNSDKLIARKKDWDPKKYGGFDSPTVAYSVLVVAKVEKGKSKKLKSVKE

LLGITIMERSSFEKNPIDFLEAKGYKEVKKDLIIKLPKYSLFELENGRKR

MLASAGELQKGNELALPSKYVNFLYLASHYEKLKGSPEDNEQKQLFVEQH

KHYLDEIIEQISEFSKRVILADANLDKVLSAYNKHRDKPIREQAENIIHL

FTLTNLGAPAAFKYFDTTIDRKRYTSTKEVLDATLIHQSITGLYETRIDL

SQLGGD pSAMca053 dCas9(HNH-->P65, 6XGS) - DNA
(SEQ ID NO: 195)
gGACAAGAAGTACAGCATCGGCCTGGCCATCGGCACCAACTCTGTGGGCT

GGGCCGTGATCACCGACGAGTACAAGGTGCCCAGCAAGAAATTCAAGGTG

CTGGGCAACACCGACCGGCACAGCATCAAGAAGAACCTGATCGGAGCCCT

GCTGTTCGACAGCGGCGAAACAGCCGAGGCCACCCGGCTGAAGAGAACCG

CCAGAAGAAGATACACCAGACGGAAGAACCGGATCTGCTATCTGCAAGAG

ATCTTCAGCAACGAGATGGCCAAGGTGGACGACAGCTTCTTCCACAGACT

GGAAGAGTCCTTCCTGGTGGAAGAGGATAAGAAGCACGAGCGGCACCCCA

TCTTCGGCAACATCGTGGACGAGGTGGCCTACCACGAGAAGTACCCCACC

ATCTACCACCTGAGAAAGAAACTGGTGGACAGCACCGACAAGGCCGACCT

GCGGCTGATCTATCTGGCCCTGGCCCACATGATCAAGTTCCGGGGCCACT

TCCTGATCGAGGGCGACCTGAACCCCGACAACAGCGACGTGGACAAGCTG

TTCATCCAGCTGGTGCAGACCTACAACCAGCTGTTCGAGGAAAACCCCAT

CAACGCCAGCGGCGTGGACGCCAAGGCCATCCTGTCTGCCAGACTGAGCA

AGAGCAGACGGCTGGAAAATCTGATCGCCCAGCTGCCCGGCGAGAAGAAG

AATGGCCTGTTCGGCAACCTGATTGCCCTGAGCCTGGGCCTGACCCCCAA

CTTCAAGAGCAACTTCGACCTGGCCGAGGATGCCAAACTGCAGCTGAGCA

AGGACACCTACGACGACGACCTGGACAACCTGCTGGCCCAGATCGGCGAC

CAGTACGCCGACCTGTTTCTGGCCGCCAAGAACCTGTCCGACGCCATCCT

GCTGAGCGACATCCTGAGAGTGAACACCGAGATCACCAAGGCCCCCCTGA

GCGCCTCTATGATCAAGAGATACGACGAGCACCACCAGGACCTGACCCTG

CTGAAAGCTCTCGTGCGGCAGCAGCTGCCTGAGAAGTACAAAGAGATTTT

CTTCGACCAGAGCAAGAACGGCTACGCCGGCTACATTGACGGCGGAGCCA

GCCAGGAAGAGTTCTACAAGTTCATCAAGCCCATCCTGGAAAAGATGGAC

GGCACCGAGGAACTGCTCGTGAAGCTGAACAGAGAGGACCTGCTGCGGAA

GCAGCGGACCTTCGACAACGGCAGCATCCCCCACCAGATCCACCTGGGAG

AGCTGCACGCCATTCTGCGGCGGCAGGAAGATTTTTACCCATTCCTGAAG

GACAACCGGGAAAAGATCGAGAAGATCCTGACCTTCCGCATCCCCTACTA

CGTGGGCCCTCTGGCCAGGGGAAACAGCAGATTCGCCTGGATGACCAGAA

AGAGCGAGGAAACCATCACCCCCTGGAACTTCGAGGAAGTGGTGGACAAG

GGCGCTTCCGCCCAGAGCTTCATCGAGCGGATGACCAACTTCGATAAGAA

CCTGCCCAACGAGAAGGTGCTGCCCAAGCACAGCCTGCTGTACGAGTACT

TCACCGTGTATAACGAGCTGACCAAAGTGAAATACGTGACCGAGGGAATG

AGAAAGCCCGCCTTCCTGAGCGGCGAGCAGAAAAAGGCCATCGTGGACCT

GCTGTTCAAGACCAACCGGAAAGTGACCGTGAAGCAGCTGAAAGAGGACT

ACTTCAAGAAAATCGAGTGCTTCGACTCCGTGGAAATCTCCGGCGTGGAA

GATCGGTTCAACGCCTCCCTGGGCACATACCACGATCTGCTGAAAATTAT

CAAGGACAAGGACTTCCTGGACAATGAGGAAAACGAGGACATTCTGGAAG

ATATCGTGCTGACCCTGACACTGTTTGAGGACAGAGAGATGATCGAGGAA

CGGCTGAAAACCTATGCCCACCTGTTCGACGACAAAGTGATGAAGCAGCT

GAAGCGGCGGAGATACACCGGCTGGGGCAGGCTGAGCCGGAAGCTGATCA

ACGGCATCCGGGACAAGCAGTCCGGCAAGACAATCCTGGATTTCCTGAAG

TCCGACGGCTTCGCCAACAGAAACTTCATGCAGCTGATCCACGACGACAG

CCTGACCTTTAAAGAGGACATCCAGAAAGCCCAGGTGTCCGGCCAGGGCG

ATAGCCTGCACGAGCACATTGCCAATCTGGCCGGCAGCCCCGCCATTAAG

AAGGGCATCCTGCAGACAGTGAAGGTGGTGGACGAGCTCGTGAAAGTGAT

GGGCCGGCACAAGCCCGAGAACATCGTGATCGAAATGGCCAGAGAGAACC

AGACCACCCAGAAGGGACAGAAGGGGGGTGGTGGAAGTGGCGGTGGCGGC

TCCGGAGGAGGAGGAAGCGGCGGCGGTGGTAGTGGCGGCGGCGGAAGCGG

AGGCGGCGGCTCCCCTTCAGGGCAGATCAGCAACCAGGCCCTGGCTCTGG

CCCCTAGCTCCGCTCCAGTGCTGGCCCAGACTATGGTGCCCTCTAGTGCT

ATGGTGCCTCTGGCCCAGCCACCTGCTCCAGCCCCTGTGCTGACCCCAGG

ACCACCCCAGTCACTGAGCGCTCCAGTGCCCAAGTCTACACAGGCCGGCG

AGGGGACTCTGAGTGAAGCTCTGCTGCACCTGCAGTTCGACGCTGATGAG

GACCTGGGAGCTCTGCTGGGGAACAGCACCGATCCCGGAGTGTTCACAGA

TCTGGCCTCCGTGGACAACTCTGAGTTTCAGCAGCTGCTGAATCAGGGCG

TGTCCATGTCTCATAGTACAGCCGAACCAATGCTGATGGAGTACCCCGAA

GCCATTACCCGGCTGGTGACCGGCAGCCAGCGGCCCCCCGACCCCGCTCC

AACTCCCCTGGGAACCAGCGGCCTGCCTAATGGGCTGTCCGGAGATGAAG

ACTTCTCAAGCATCGCTGATATGGACTTTAGTGCCCTGCTGTCACAGATT

TCCTCTAGTGGGCAGGGGGTGGTGGAAGTGGCGGTGGCGGCTCCGGAGG

AGGAGGAAGCGGCGGCGGTGGTAGTGGCGGCGGCGGAAGCGGAGGCGGCG

GCTCCACCAAGGCCGAGAGAGGCGGCCTGAGCGAACTGGATAAGGCCGGC

TTCATCAAGAGACAGCTGGTGGAAACCCGGCAGATCACAAAGCACGTGGC

ACAGATCCTGGACTCCCGGATGAACACTAAGTACGACGAGAATGACAAGC

TGATCCGGGAAGTGAAAGTGATCACCCTGAAGTCCAAGCTGGTGTCCGAT

TTCCGGAAGGATTTCCAGTTTTACAAAGTGCGCGAGATCAACAACTACCA

CCACGCCCACGACGCCTACCTGAACGCCGTCGTGGGAACCGCCCTGATCA

AAAAGTACCCTAAGCTGGAAAGCGAGTTCGTGTACGGCGACTACAAGGTG

TACGACGTGCGCGAAGATGATCGCCAAGAGCGAGCAGGAAATCGGCAAGGC

TACCGCCAAGTACTTCTTCTACAGCAACATCATGAACTTTTTCAAGACCG

```
AGATTACCCTGGCCAACGGCGAGATCCGGAAGCGGCCTCTGATCGAGACA
AACGGCGAAACCGGGGAGATCGTGTGGGATAAGGGCCGGGATTTTGCCAC
CGTGCGGAAAGTGCTGAGCATGCCCCAAGTGAATATCGTGAAAAAGACCG
AGGTGCAGACAGGCGGCTTCAGCAAAGAGTCTATCCTGCCCAAGAGGAAC
AGCGATAAGCTGATCGCCAGAAAGAAGGACTGGGACCCTAAGAAGTACGG
CGGCTTCGACAGCCCCACCGTGGCCTATTCTGTGCTGGTGGTGGCCAAAG
TGGAAAAGGGCAAGTCCAAGAAACTGAAGAGTGTGAAAGAGCTGCTGGGG
ATCACCATCATGGAAAGAAGCAGCTTCGAGAAGAATCCCATCGACTTTCT
GGAAGCCAAGGGCTACAAAGAAGTGAAAAAGGACCTGATCATCAAGCTGC
CTAAGTACTCCCTGTTCGAGCTGGAAAACGGCCGGAAGAGAATGCTGGCC
TCTGCCGGCGAACTGCAGAAGGGAAACGAACTGGCCCTGCCCTCCAAATA
TGTGAACTTCCTGTACCTGGCCAGCCACTATGAGAAGCTGAAGGGCTCCC
CCGAGGATAATGAGCAGAAACAGCTGTTTGTGGAACAGCACAAGCACTAC
CTGGACGAGATCATCGAGCAGATCAGCGAGTTCTCCAAGAGAGTGATCCT
GGCCGACGCTAATCTGGACAAAGTGCTGTCCGCCTACAACAAGCACCGGG
ATAAGCCCATCAGAGAGCAGGCCGAGAATATCATCCACCTGTTTACCCTG
ACCAATCTGGGAGCCCCTGCCGCCTTCAAGTACTTTGACACCACCATCGA
CCGGAAGAGGTACACCAGCACCAAAGAGGTGCTGGACGCCACCCTGATCC
ACCAGAGCATCACCGGCCTGTACGAGACACGGATCGACCTGTCTCAGCTG
GGAGGCGACAgcgctGGAGGAGGTGGAAGCGGAGGAGGAGGAAGCGGAGG
AGGAGGTAGCggacctaagaaaaagaggaaggtggc
pSAMca053 dCas9(HNH-->P65, 6XGS) - AA
                             (SEQ ID NO: 196)
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFDSVEISGVEDRFNASLGTYHDLLKII
KDKDFLDNEENEDILEDIVLTLTLFEDREMIEERLKTYAHLFDDKVMKQL
KRRRYTGWGRLSRKLINGIRDKQSGKTILDFLKSDGFANRNFMQLIHDDS
LTFKEDIQKAQVSGQGDSLHEHIANLAGSPAIKKGILQTVKVVDELVKVM
GRHKPENIVIEMARENQTTQKGQKGGGGSGGGGSGGGGSGGGGSGGGGSG
GGGSPSGQISNQALALAPSSAPVLAQTMVPSSAMVPLAQPPAPAPVLTPG
PPQSLSAPVPKSTQAGEGTLSEALLHLQFDADEDLGALLGNSTDPGVFTD
LASVDNSEFQQLLNQGVSMSHSTAEPMLMEYPEAITRLVTGSQRPPDPAP
TPLGTSGLPNGLSGDEDFSSIADMDFSALLSQISSSGQGGGGSGGGGSGG
GGSGGGGSGGGGSGGGGSTKAERGGLSELDKAGFIKRQLVETRQITKHVA
QILDSRMNTKYDENDKLIREVKVITLKSKLVSDFRKDFQFYKVREINNYH
HAHDAYLNAVVGTALIKKYPKLESEFVYGDYKVYDVRKMIAKSEQEIGKA
TAKYFFYSNIMNFFKTEITLANGEIRKRPLIETNGETGEIVWDKGRDFAT
VRKVLSMPQVNIVKKTEVQTGGFSKESILPKRNSDKLIARKKDWDPKKYG
GFDSPTVAYSVLVVAKVEKGKSKKLKSVKELLGITIMERSSFEKNPIDFL
EAKGYKEVKKDLIIKLPKYSLFELENGRKRMLASAGELQKGNELALPSKY
VNFLYLASHYEKLKGSPEDNEQKQLFVEQHKHYLDEIIEQISEFSKRVIL
ADANLDKVLSAYNKHRDKPIREQAENIIHLFTLTNLGAPAAFKYFDTTID
RKRYTSTKEVLDATLIHQSITGLYETRIDLSQLGGD
```

Insertions of transcriptional domains into 3 loops of dCas9

```
pSAMca054 dCas9(G533-vp64, 1XGS) - DNA
                             (SEQ ID NO: 197)
GACAAGAAGTACAGCATCGGCCTGGCCATCGGCACCAACTCTGTGGGCTG
GGCCGTGATCACCGACGAGTACAAGGTGCCCAGCAAGAAATTCAAGGTGC
TGGGCAACACCGACCGGCACAGCATCAAGAAGAACCTGATCGGAGCCCTG
CTGTTCGACAGCGGCGAAACAGCCGAGGCCACCCGGCTGAAGAGAACCGC
CAGAAGAAGATACACCAGACGGAAGAACCGGATCTGCTATCTGCAAGAGA
TCTTCAGCAACGAGATGGCCAAGGTGGACGACAGCTTCTTCCACAGACTG
GAAGAGTCCTTCCTGGTGGAAGAGGATAAGAAGCACGAGCGGCACCCCAT
CTTCGGCAACATCGTGGACGAGGTGGCCTACCACGAGAAGTACCCCACCA
TCTACCACCTGAGAAAGAAACTGGTGGACAGCACCGACAAGGCCGACCTG
CGGCTGATCTATCTGGCCCTGGCCCACATGATCAAGTTCCGGGGCCACTT
CCTGATCGAGGGCGACCTGAACCCCGACAACAGCGACGTGGACAAGCTGT
TCATCCAGCTGGTGCAGACCTACAACCAGCTGTTCGAGGAAAACCCCATC
AACGCCAGCGGCGTGGACGCCAAGGCCATCCTGTCTGCCAGACTGAGCAA
GAGCAGACGGCTGGAAAATCTGATCGCCCAGCTGCCCGGCGAGAAGAAGA
ATGGCCTGTTCGGCAACCTGATTGCCCTGAGCCTGGGCCTGACCCCCAAC
TTCAAGAGCAACTTCGACCTGGCCGAGGATGCCAAACTGCAGCTGAGCAA
GGACACCTACGACGACGACCTGGACAACCTGCTGGCCCAGATCGGCGACC
AGTACGCCGACCTGTTTCTGGCCGCCAAGAACCTGTCCGACGCCATCCTG
CTGAGCGACATCCTGAGAGTGAACACCGAGATCACCAAGGCCCCCCTGAG
CGCCTCTATGATCAAGAGATACGACGAGCACCACCAGGACCTGACCCTGC
TGAAAGCTCTCGTGCGGCAGCAGCTGCCTGAGAAGTACAAAGAGATTTTC
TTCGACCAGAGCAAGAACGGCTACGCGGGCTACATTGACGGCGGAGCCAG
CCAGGAAGAGTTCTACAAGTTCATCAAGCCCATCCTGGAAAAGATGGACG
GCACCGAGGAACTGCTCGTGAAGCTGAACAGAGAGGACCTGCTGCGGAAG
CAGCGGACCTTCGACAACGGCAGCATCCCCCACCAGATCCACCTGGGAGA
```

```
GCTGCACGCCATTCTGCGGCGGCAGGAAGATTTTTACCCATTCCTGAAGG
ACAACCGGGAAAAGATCGAGAAGATCCTGACCTTCCGCATCCCCTACTAC
GTGGGCCCTCTGGCCAGGGGAAACAGCAGATTCGCCTGGATGACCAGAAA
GAGCGAGGAAACCATCACCCCCTGGAACTTCGAGGAAGTGGTGGACAAGG
GCGCTTCCGCCCAGAGCTTCATCGAGCGGATGACCAACTTCGATAAGAAC
CTGCCCAACGAGAAGGTGCTGCCCAAGCACAGCCTGCTGTACGAGTACTT
CACCGTGTATAACGAGCTGACCAAAGTGAAATACGTGACCGAGGGAGGAG
GGGGGGGCAGCGGACGGGCTGACGCATTGACGATTTTGATCTGGATATG
CTGGGAAGTGACGCCCTCGATGATTTTGACCTTGACATGCTTGGTTCGGA
TGCCCTTGATGACTTTGACCTCGACATGCTCGGCAGTGACGCCCTTGATG
ATTTCGACCTGGACATGCTGATTAACGGCGGGGGAGGCTCCATGAGAAAG
CCCGCCTTCCTGAGCGGCGAGCAGAAAAAGGCCATCGTGGACCTGCTGTT
CAAGACCAACCGGAAAGTGACCGTGAAGCAGCTGAAAGAGGACTACTTCA
AGAAAATCGAGTGCTTCGACTCCGTGGAAATCTCCGGCGTGGAAGATCGG
TTCAACGCCTCCCTGGGCACATACCACGATCTGCTGAAAATTATCAAGGA
CAAGGACTTCCTGGACAATGAGGAAAACGAGGACATTCTGGAAGATATCG
TGCTGACCCTGACACTGTTTGAGGACAGAGAGATGATCGAGGAACGGCTG
AAAACCTATGCCCACCTGTTCGACGACAAAGTGATGAAGCAGCTGAAGCG
GCGGAGATACACCGGCTGGGGCAGGCTGAGCCGGAAGCTGATCAACGGCA
TCCGGGACAAGCAGTCCGGCAAGACAATCCTGGATTTCCTGAAGTCCGAC
GGCTTCGCCAACAGAAACTTCATGCAGCTGATCCACGACGACAGCCTGAC
CTTTAAGGAGGACATCCAGAAAGCCCAGGTGTCCGGCCAGGGCGATAGCC
TGCACGAGCACATTGCCAATCTGGCCGGCAGCCCCGCCATTAAGAAGGGC
ATCCTGCAGACAGTGAAGGTGGTGGACGAGCTCGTGAAAGTGATGGGCCG
GCACAAGCCCGAGAACATCGTGATCGAAATGGCCAGAGAGAACCAGACCA
CCCAGAAGGGACAGAAGAACAGCCGCGAGAGAATGAAGCGGATCGAAGAG
GGCATCAAAGAGCTGGGCAGCCAGATCCTGAAAGAACACCCCGTGGAAAA
CACCCAGCTGCAGAACGAGAAGCTGTACCTGTACTACCTGCAGAATGGGC
GGGATATGTACGTGGACCAGGAACTGGACATCAACCGGCTGTCCGACTAC
GATGTGGACgcTATCGTGCCTCAGAGCTTTCTGAAGGACGACTCCATCGA
CAACAAGGTGCTGACCAGAAGCGACAAGAACCGGGGCAAGAGCGACAACG
TGCCCTCCGAAGAGGTCGTGAAGAAGATGAAGAACTACTGGCGGCAGCTG
CTGAACGCCAAGCTGATTACCCAGAGAAAGTTCGACAATCTGACCAAGGC
CGAGAGAGGCGGCCTGAGCGAACTGGATAAGGCCGGCTTCATCAAGAGAC
AGCTGGTGGAAACCCGGCAGATCACAAAGCACGTGGCACAGATCCTGGAC
TCCCGGATGAACACTAAGTACGACGAGAATGACAAGCTGATCCGGGAAGT
GAAAGTGATCACCCTGAAGTCCAAGCTGGTGTCCGATTTCCGGAAGGATT
TCCAGTTTTACAAAGTGCGCGAGATCAACAACTACCACCACGCCCACGAC
GCCTACCTGAACGCCGTCGTGGGAACCGCCCTGATCAAAAAGTACCCTAA
GCTGGAAAGCGAGTTCGTGTACGGCGACTACAAGGTGTACGACGTGCGGA
AGATGATCGCCAAGAGCGAGCAGGAAATCGGCAAGGCTACCGCCAAGTAC
```
```
TTCTTCTACAGCAACATCATGAACTTTTTCAAGACCGAGATTACCCTGGC
CAACGGCGAGATCCGGAAGCGGCCTCTGATCGAGACAAACGGCGAAACCG
GGGAGATCGTGTGGGATAAGGGCCGGGATTTTGCCACCGTGCGGAAAGTG
CTGAGCATGCCCCAAGTGAATATCGTGAAAAAGACCGAGGTGCAGACAGG
CGGCTTCAGCAAAGAGTCTATCCTGCCCAAGAGGAACAGCGATAAGCTGA
TCGCCAGAAAGAAGGACTGGGACCCTAAGAAGTACGGCGGCTTCGACAGC
CCCACCGTGGCCTATTCTGTGCTGGTGGTGGCCAAAGTGGAAAAGGGCAA
GTCCAAGAAACTGAAGAGTGTGAAAGAGCTGCTGGGGATCACCATCATGG
AAAGAAGCAGCTTCGAGAAGAATCCCATCGACTTTCTGGAAGCCAAGGGC
TACAAAGAAGTGAAAAAGGACCTGATCATCAAGCTGCCTAAGTACTCCCT
GTTCGAGCTGGAAAACGGCCGGAAGAGAATGCTGGCCTCTGCCGGCGAAC
TGCAGAAGGGAAACGAACTGGCCCTGCCCTCCAAATATGTGAACTTCCTG
TACCTGGCCAGCCACTATGAGAAGCTGAAGGGCTCCCCCGAGGATAATGA
GCAGAAACAGCTGTTTGTGGAACAGCACAAGCACTACCTGGACGAGATCA
TCGAGCAGATCAGCGAGTTCTCCAAGAGAGTGATCCTGGCCGACGCTAAT
CTGGACAAAGTGCTGTCCGCCTACAACAAGCACCGGGATAAGCCCATCAG
AGAGCAGGCCGAGAATATCATCCACCTGTTTACCCTGACCAATCTGGGAG
CCCCTGCCGCCTTCAAGTACTTTGACACCACCATCGACCGGAAGAGGTAC
ACCAGCACCAAAGAGGTGCTGGACGCCACCCTGATCCACCAGAGCATCAC
CGGCCTGTACGAGACACGGATCGACCTGTCTCAGCTGGGAGGCGACAgcg
ctGGAGGAGGTGGAAGCGGAGGAGGAGGAAGCGGAGGAGGAGGTAGCgga
cctaagaaaaagaggaaggtggcggccgct
pSAMca054 dCas9(G533-vp64, 1XGS) - AA
                                    (SEQ ID NO: 198)
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGGGGSGRADALDDFDLDM
LGSDALDDFDLDMLGSDALDDFDLDMLGSDALDDFDLDMLINGGGGSMRK
PAFLSGEQKKAIVDLLFKTNRKVTVKQLKEDYFKKIECFDSVEISGVEDR
FNASLGTYHDLLKIIKDKDFLDNEENEDILEDIVLTLTLFEDREMIEERL
KTYAHLFDDKVMKQLKRRRYTGWGRLSRKLINGIRDKQSGKTILDFLKSD
GFANRNFMQLIHDDSLTFKEDIQKAQVSGQGDSLHEHIANLAGSPAIKKG
ILQTVKVVDELVKVMGRHKPENIVIEMARENQTTQKGQKNSRERMKRIEE
```

-continued

GIKELGSQILKEHPVENTQLQNEKLYLYYLQNGRDMYVDQELDINRLSDY
DVDAIVPQSFLKDDSIDNKVLTRSDKNRGKSDNVPSEEVVKKMKNYWRQL
LNAKLITQRKFDNLTKAERGGLSELDKAGFIKRQLVETRQITKHVAQILD
SRMNTKYDENDKLIREVKVITLKSKLVSDFRKDFQFYKVREINNYHHAHD
AYLNAVVGTALIKKYPKLESEFVYGDYKVYDVRKMIAKSEQEIGKATAKY
FFYSNIMNFFKTEITLANGEIRKRPLIETNGETGEIVWDKGRDFATVRKV
LSMPQVNIVKKTEVQTGGFSKESILPKRNSDKLIARKKDWDPKKYGGFDS
PTVAYSVLVVAKVEKGKSKKLKSVKELLGITIMERSSFEKNPIDFLEAKG
YKEVKKDLIIKLPKYSLFELENGRKRMLASAGELQKGNELALPSKYVNFL
YLASHYEKLKGSPEDNEQKQLFVEQHKHYLDEIIEQISEFSKRVILADAN
LDKVLSAYNKHRDKPIREQAENIIHLFTLTNLGAPAAFKYFDTTIDRKRY
TSTKEVLDATLIHQSITGLYETRIDLSQLGGDSAGGGGSGGGGSGGGGSG
PKKKRKVAAA pSAMca055 dCas9(G533-vp64, 3XGS) - DNA
(SEQ ID NO: 199)
GACAAGAAGTACAGCATCGGCCTGGCCATCGGCACCAACTCTGTGGGCTG
GGCCGTGATCACCGACGAGTACAAGGTGCCCAGCAAGAAATTCAAGGTGC
TGGGCAACACCGACCGGCACAGCATCAAGAAGAACCTGATCGGAGCCCTG
CTGTTCGACAGCGGCGAAACAGCCGAGGCCACCCGGCTGAAGAGAACCGC
CAGAAGAAGATACACCAGACGGAAGAACCGGATCTGCTATCTGCAAGAGA
TCTTCAGCAACGAGATGGCCAAGGTGGACGACAGCTTCTTCCACAGACTG
GAAGAGTCCTTCCTGGTGGAAGAGGATAAGAAGCACGAGCGGCACCCCAT
CTTCGGCAACATCGTGGACGAGGTGGCCTACCACGAGAAGTACCCCACCA
TCTACCACCTGAGAAAGAAACTGGTGGACAGCACCGACAAGGCCGACCTG
CGGCTGATCTATCTGGCCCTGGCCCACATGATCAAGTTCCGGGGCCACTT
CCTGATCGAGGGCGACCTGAACCCCGACAACAGCGACGTGGACAAGCTGT
TCATCCAGCTGGTGCAGACCTACAACCAGCTGTTCGAGGAAAACCCCATC
AACGCCAGCGGCGTGGACGCCAAGGCCATCCTGTCTGCCAGACTGAGCAA
GAGCAGACGGCTGGAAAATCTGATCGCCCAGCTGCCCGGCGAGAAGAAGA
ATGGCCTGTTCGGCAACCTGATTGCCCTGAGCCTGGGCCTGACCCCCAAC
TTCAAGAGCAACTTCGACCTGGCCGAGGATGCCAAACTGCAGCTGAGCAA
GGACACCTACGACGACGACCTGGACAACCTGCTGGCCCAGATCGGCGACC
AGTACGCCGACCTGTTTCTGGCCGCCAAGAACCTGTCCGACGCCATCCTG
CTGAGCGACATCCTGAGAGTGAACACCGAGATCACCAAGGCCCCCCTGAG
CGCCTCTATGATCAAGAGATACGACGAGCACCACCAGGACCTGACCCTGC
TGAAAGCTCTCGTGCGGCAGCAGCTGCCTGAGAAGTACAAAGAGATTTTC
TTCGACCAGAGCAAGAACGGCTACGCCGGCTACATTGACGGCGGAGCCAG
CCAGGAAGAGTTCTACAAGTTCATCAAGCCCATCCTGGAAAAGATGGACG
GCACCGAGGAACTGCTCGTGAAGCTGAACAGAGAGGACCTGCTGCGGAAG
CAGCGGACCTTCGACAACGGCAGCATCCCCCACCAGATCCACCTGGGAGA
GCTGCACGCCATTCTGCGGCGGCAGGAAGATTTTTACCCATTCCTGAAGG
ACAACCGGGAAAAGATCGAGAAGATCCTGACCTTCCGCATCCCCTACTAC

GTGGGCCCTCTGGCCAGGGGAAACAGCAGATTCGCCTGGATGACCAGAAA
GAGCGAGGAAACCATCACCCCCTGGAACTTCGAGGAAGTGGTGGACAAGG
GCGCTTCCGCCCAGAGCTTCATCGAGCGGATGACCAACTTCGATAAGAAC
CTGCCCAACGAGAAGGTGCTGCCCAAGCACAGCCTGCTGTACGAGTACTT
CACCGTGTATAACGAGCTGACCAAAGTGAAATACGTGACCGAGGGAGGAG
GGGGGGGCAGCGGACGGGCTGACGCATTGGACGATTTTGATCTGGATATG
CTGGGAAGTGACGCCCTCGATGATTTTGACCTTGACATGCTTGGTTCGGA
TGCCCTTGATGACTTTGACCTCGACATGCTCGGCAGTGACGCCCTTGATG
ATTTCGACCTGGACATGCTGATTAACGGCGGGGGAGGCTCCATGAGAAAG
CCCGCCTTCCTGAGCGGCGAGCAGAAAAAGGCCATCGTGGACCTGCTGTT
CAAGACCAACCGGAAAGTGACCGTGAAGCAGCTGAAAGAGGACTACTTCA
AGAAAATCGAGTGCTTCGACTCCGTGGAAATCTCCGGCGTGGAAGATCGG
TTCAACGCCTCCCTGGGCACATACCACGATCTGCTGAAAATTATCAAGGA
CAAGGACTTCCTGGACAATGAGGAAAACGAGGACATTCTGGAAGATATCG
TGCTGACCCTGACACTGTTTGAGGACAGAGAGATGATCGAGGAACGGCTG
AAAACCTATGCCCACCTGTTCGACGACAAAGTGATGAAGCAGCTGAAGCG
GCGGAGATACACCGGCTGGGGCAGGCTGAGCCGGAAGCTGATCAACGGCA
TCCGGGACAAGCAGTCCGGCAAGACAATCCTGGATTTCCTGAAGTCCGAC
GGCTTCGCCAACAGAAACTTCATGCAGCTGATCCACGACGACAGCCTGAC
CTTTAAAGAGGACATCCAGAAAGCCCAGGTGTCCGGCCAGGGCGATAGCC
TGCACGAGCACATTGCCAATCTGGCCGGCAGCCCCGCCATTAAGAAGGGC
ATCCTGCAGACAGTGAAGGTGGTGGACGAGCTCGTGAAAGTGATGGGCCG
GCACAAGCCCGAGAACATCGTGATCGAAATGGCCAGAGAGAACCAGACCA
CCCAGAAGGGACAGAAGAACAGCCGCGAGAGAATGAAGCGGATCGAAGAG
GGCATCAAAGAGCTGGGCAGCCAGATCCTGAAAGAACACCCCGTGGAAAA
CACCCAGCTGCAGAACGAGAAGCTGTACCTGTACTACCTGCAGAATGGGC
GGGATATGTACGTGGACCAGGAACTGGACATCAACCGGCTGTCCGACTAC
GATGTGGACgcTATCGTGCCTCAGAGCTTTCTGAAGGACGACTCCATCGA
CAACAAGGTGCTGACCAGAAGCGACAAGAACCGGGGCAAGAGCGACAACG
TGCCCTCCGAAGAGGTCGTGAAGAAGATGAAGAACTACTGGCGGCAGCTG
CTGAACGCCAAGCTGATTACCCAGAGAAAGTTCGACAATCTGACCAAGGC
CGAGAGAGGCGGCCTGAGCGAACTGGATAAGGCCGGCTTCATCAAGAGAC
AGCTGGTGGAAACCCGGCAGATCACAAAGCACGTGGCACAGATCCTGGAC
TCCCGGATGAACACTAAGTACGACGAGAATGACAAGCTGATCCGGGAAGT
GAAAGTGATCACCCTGAAGTCCAAGCTGGTGTCCGATTTCCGGAAGGATT
TCCAGTTTTACAAAGTGCGCGAGATCAACAACTACCACCACGCCCACGAC
GCCTACCTGAACGCCGTCGTGGGAACCGCCCTGATCAAAAAGTACCCTAA
GCTGGAAAGCGAGTTCGTGTACGGCGACTACAAGGTGTACGACGTGCGGA
AGATGATCGCCAAGAGCGAGCAGGAAATCGGCAAGGCTACCGCCAAGTAC
TTCTTCTACAGCAACATCATGAACTTTTTCAAGACCGAGATTACCCTGGC

```
CAACGGCGAGATCCGGAAGCGGCCTCTGATCGAGACAAACGGCGAAACCG
GGGAGATCGTGTGGGATAAGGGCCGGGATTTTGCCACCGTGCGGAAAGTG
CTGAGCATGCCCCAAGTGAATATCGTGAAAAAGACCGAGGTGCAGACAGG
CGGCTTCAGCAAAGAGTCTATCCTGCCCAAGAGGAACAGCGATAAGCTGA
TCGCCAGAAAGAAGGACTGGGACCCTAAGAAGTACGGCGGCTTCGACAGC
CCCACCGTGGCCTATTCTGTGCTGGTGGTGGCCAAAGTGGAAAAGGGCAA
GTCCAAGAAACTGAAGAGTGTGAAAGAGCTGCTGGGGATCACCATCATGG
AAAGAAGCAGCTTCGAGAAGAATCCCATCGACTTTCTGGAAGCCAAGGGC
TACAAAGAAGTGAAAAAGGACCTGATCATCAAGCTGCCTAAGTACTCCCT
GTTCGAGCTGGAAAACGGCCGGAAGAGAATGCTGGCCTCTGCCGGCGAAC
TGCAGAAGGGAAACGAACTGGCCCTGCCCTCCAAATATGTGAACTTCCTG
TACCTGGCCAGCCACTATGAGAAGCTGAAGGGCTCCCCCGAGGATAATGA
GCAGAAACAGCTGTTTGTGGAACAGCACAAGCACTACCTGGACGAGATCA
TCGAGCAGATCAGCGAGTTCTCCAAGAGAGTGATCCTGGCCGACGCTAAT
CTGGACAAAGTGCTGTCCGCCTACAACAAGCACCGGGATAAGCCCATCAG
AGAGCAGGCCGAGAATATCATCCACCTGTTTACCCTGACCAATCTGGGAG
CCCCTGCCGCCTTCAAGTACTTTGACACCACCATCGACCGGAAGAGGTAC
ACCAGCACCAAAGAGGTGCTGGACGCCACCCTGATCCACCAGAGCATCAC
CGGCCTGTACGAGACACGGATCGACCTGTCTCAGCTGGGAGGCGACagcg
ctGGAGGAGGTGGAAGCGGAGGAGGAGGAAGCGGAGGAGGAGGTAGCgga
cctaagaaaaagaggaaggtggcggccgctgctag pSAMca055 dCas9(G533-vp64, 3XGS) - AA
                                        (SEQ ID NO: 200)
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGGGGSGRADALDDFDLDM
LGSDALDDFDLDMLGSDALDDFDLDMLGSDALDDFDLDMLINGGGGSMRK
PAFLSGEQKKAIVDLLFKTNRKVTVKQLKEDYFKKIECFDSVEISGVEDR
FNASLGTYHDLLKIIKDKDFLDNEENEDILEDIVLTLTLFEDREMIEERL
KTYAHLFDDKVMKQLKRRRYTGWGRLSRKLINGIRDKQSGKTILDFLKSD
GFANRNFMQLIHDDSLTFKEDIQKAQVSGQGDSLHEHIANLAGSPAIKKG
ILQTVKVVDELVKVMGRHKPENIVIEMARENQTTQKGQKNSRERMKRIEE
GIKELGSQILKEHPVENTQLQNEKLYLYYLQNGRDMYVDQELDINRLSDY
DVDAIVPQSFLKDDSIDNKVLTRSDKNRGKSDNVPSEEVVKKMKNYWRQL
LNAKLITQRKFDNLTKAERGGLSELDKAGFIKRQLVETRQITKHVAQILD
SRMNTKYDENDKLIREVKVITLKSKLVSDFRKDFQFYKVREINNYHHAHD
AYLNAVVGTALIKKYPKLESEFVYGDYKVYDVRKMIAKSEQEIGKATAKY
FFYSNIMNFFKTEITLANGEIRKRPLIETNGETGEIVWDKGRDFATVRKV
LSMPQVNIVKKTEVQTGGFSKESILPKRNSDKLIARKKDWDPKKYGGFDS
PTVAYSVLVVAKVEKGKSKKLKSVKELLGITIMERSSFEKNPIDFLEAKG
YKEVKKDLIIKLPKYSLFELENGRKRMLASAGELQKGNELALPSKYVNFL
YLASHYEKLKGSPEDNEQKQLFVEQHKHYLDEIIEQISEFSKRVILADAN
LDKVLSAYNKHRDKPIREQAENIIHLFTLTNLGAPAAFKYFDTTIDRKRY
TSTKEVLDATLIHQSITGLYETRIDLSQLGGDSAGGGSGGGGSGGGGSG
PKKKRKVAAAA pSAMca056 dCas9(G533-P65, 1XGS) - DNA
                                        (SEQ ID NO: 201)
GACAAGAAGTACAGCATCGGCCTGGCCATCGGCACCAACTCTGTGGGCTG
GGCCGTGATCACCGACGAGTACAAGGTGCCCAGCAAGAAATTCAAGGTGC
TGGGCAACACCGACCGGCACAGCATCAAGAAGAACCTGATCGGAGCCCTG
CTGTTCGACAGCGGCGAAACAGCCGAGGCCACCCGGCTGAAGAGAACCGC
CAGAAGAAGATACACCAGACGGAAGAACCGGATCTGCTATCTGCAAGAGA
TCTTCAGCAACGAGATGGCCAAGGTGGACGACAGCTTCTTCCACAGACTG
GAAGAGTCCTTCCTGGTGGAAGAGGATAAGAAGCACGAGCGGCACCCCAT
CTTCGGCAACATCGTGGACGAGGTGGCCTACCACGAGAAGTACCCCACCA
TCTACCACCTGAGAAAGAAACTGGTGGACAGCACCGACAAGGCCGACCTG
CGGCTGATCTATCTGGCCCTGGCCCACATGATCAAGTTCCGGGGCCACTT
CCTGATCGAGGGCGACCTGAACCCCGACAACAGCGACGTGGACAAGCTGT
TCATCCAGCTGGTGCAGACCTACAACCAGCTGTTCGAGGAAAACCCCATC
AACGCCAGCGGCGTGGACGCCAAGGCCATCCTGTCTGCCAGACTGAGCAA
GAGCAGACGGCTGGAAAATCTGATCGCCCAGCTGCCCGGCGAGAAGAAGA
ATGGCCTGTTCGGCAACCTGATTGCCCTGAGCCTGGGCCTGACCCCCAAC
TTCAAGAGCAACTTCGACCTGGCCGAGGATGCCAAACTGCAGCTGAGCAA
GGACACCTACGACGACGACCTGGACAACCTGCTGGCCCAGATCGGCGACC
AGTACGCCGACCTGTTTCTGGCCGCCAAGAACCTGTCCGACGCCATCCTG
CTGAGCGACATCCTGAGAGTGAACACCGAGATCACCAAGGCCCCCCTGAG
CGCCTCTATGATCAAGAGATACGACGAGCACCACCAGGACCTGACCCTGC
TGAAAGCTCTCGTGCGGCAGCAGCTGCCTGAGAAGTACAAAGAGATTTTC
TTCGACCAGAGCAAGAACGGCTACGCCGGCTACATTGACGGCGGAGCCAG
CCAGGAAGAGTTCTACAAGTTCATCAAGCCCATCCTGGAAAAGATGGACG
GCACCGAGGAACTGCTCGTGAAGCTGAACAGAGAGGACCTGCTGCGGAAG
CAGCGGACCTTCGACAACGGCAGCATCCCCCACCAGATCCACCTGGGAGA
GCTGCACGCCATTCTGCGGCGGCAGGAAGATTTTTACCCATTCCTGAAGG
ACAACCGGGAAAAGATCGAGAAGATCCTGACCTTCCGCATCCCCTACTAC
GTGGGCCCTCTGGCCAGGGGAAACAGCAGATTCGCCTGGATGACCAGAAA
```

```
GAGCGAGGAAACCATCACCCCCTGGAACTTCGAGGAAGTGGTGGACAAGG
GCGCTTCCGCCCAGAGCTTCATCGAGCGGATGACCAACTTCGATAAGAAC
CTGCCCAACGAGAAGGTGCTGCCCAAGCACAGCCTGCTGTACGAGTACTT
CACCGTGTATAACGAGCTGACCAAAGTGAAATACGTGACCGAGGGAGGAG
GGGGAGGCAGCCCTTCAGGGCAGATCAGCAACCAGGCCCTGGCTCTGGCC
CCTAGCTCCGCTCCAGTGCTGGCCCAGACTATGGTGCCCTCTAGTGCTAT
GGTGCCTCTGGCCCAGCCACCTGCTCCAGCCCCTGTGCTGACCCCAGGAC
CACCCCAGTCACTGAGCGCTCCAGTGCCCAAGTCTACACAGGCCGGCGAG
GGGACTCTGAGTGAAGCTCTGCTGCACCTGCAGTTCGACGCTGATGAGGA
CCTGGGAGCTCTGCTGGGGAACAGCACCGATCCCGGAGTGTTCACAGATC
TGGCCTCCGTGGACAACTCTGAGTTTCAGCAGCTGCTGAATCAGGGCGTG
TCCATGTCTCATAGTACAGCCGAACCAATGCTGATGGAGTACCCCGAAGC
CATTACCCGGCTGGTGACCGGCAGCCAGCGGCCCCCCGACCCCGCTCCAA
CTCCCCTGGGAACCAGCGGCCTGCCTAATGGGCTGTCCGGAGATGAAGAC
TTCTCAAGCATCGCTGATATGGACTTTAGTGCCCTGCTGTCACAGATTTC
CTCTAGTGGGCAGGGAGGGGGGGCAGCATGAGAAAGCCCGCCTTCCTGA
GCGGCGAGCAGAAAAAGGCCATCGTGGACCTGCTGTTCAAGACCAACCGG
AAAGTGACCGTGAAGCAGCTGAAAGAGGACTACTTCAAGAAAATCGAGTG
CTTCGACTCCGTGGAAATCTCCGGCGTGGAAGATCGGTTCAACGCCTCCC
TGGGCACATACCACGATCTGCTGAAAATTATCAAGGACAAGGACTTCCTG
GACAATGAGGAAAACGAGGACATTCTGGAAGATATCGTGCTGACCCTGAC
ACTGTTTGAGGACAGAGAGATGATCGAGGAACGGCTGAAAACCTATGCCC
ACCTGTTCGACGACAAAGTGATGAAGCAGCTGAAGCGGCGGAGATACACC
GGCTGGGGCAGGCTGAGCCGGAAGCTGATCAACGGCATCCGGGACAAGCA
GTCCGGCAAGACAATCCTGGATTTCCTGAAGTCCGACGGCTTCGCCAACA
GAAACTTCATGCAGCTGATCCACGACGACAGCCTGACCTTTAAAGAGGAC
ATCCAGAAAGCCCAGGTGTCCGGCCAGGGCGATAGCCTGCACGAGCACAT
TGCCAATCTGGCCGGCAGCCCCGCCATTAAGAAGGGCATCCTGCAGACAG
TGAAGGTGGTGGACGAGCTCGTGAAAGTGATGGGCCGGCACAAGCCCGAG
AACATCGTGATCGAAATGGCCAGAGAGAACCAGACCACCCAGAAGGGACA
GAAGAACAGCCGCGAGAGAATGAAGCGGATCGAAGAGGGCATCAAAGAGC
TGGGCAGCCAGATCCTGAAAGAACACCCCGTGGAAAACACCCAGCTGCAG
AACGAGAAGCTGTACCTGTACTACCTGCAGAATGGGCGGGATATGTACGT
GGACCAGGAACTGGACATCAACCGGCTGTCCGACTACGATGTGGACgcTA
TCGTGCCTCAGAGCTTTCTGAAGGACGACTCCATCGACAACAAGGTGCTG
ACCAGAAGCGACAAGAACCGGGGCAAGAGCGACAACGTGCCCTCCGAAGA
GGTCGTGAAGAAGATGAAGAACTACTGGCGGCAGCTGCTGAACGCCAAGC
TGATTACCCAGAGAAAGTTCGACAATCTGACCAAGGCCGAGAGGCGGC
CTGAGCGAACTGGATAAGGCCGGCTTCATCAAGAGACAGCTGGTGGAAAC
CCGGCAGATCACAAAGCACGTGGCACAGATCCTGGACTCCCGGATGAACA
CTAAGTACGACGAGAATGACAAGCTGATCCGGGAAGTGAAAGTGATCACC
```

```
CTGAAGTCCAAGCTGGTGTCCGATTTCCGGAAGGATTTCCAGTTTTACAA
AGTGCGCGAGATCAACAACTACCACCACGCCCACGACGCCTACCTGAACG
CCGTCGTGGGAACCGCCCTGATCAAAAAGTACCCTAAGCTGGAAAGCGAG
TTCGTGTACGGCGACTACAAGGTGTACGACGTGCGGAAGATGATCGCCAA
GAGCGAGCAGGAAATCGGCAAGGCTACCGCCAAGTACTTCTTCTACAGCA
ACATCATGAACTTTTTCAAGACCGAGATTACCCTGGCCAACGGCGAGATC
CGGAAGCGGCCTCTGATCGAGACAAACGGCGAAACCGGGGAGATCGTGTG
GGATAAGGGCCGGGATTTTGCCACCGTGCGGAAAGTGCTGAGCATGCCCC
AAGTGAATATCGTGAAAAAGACCGAGGTGCAGACAGGCGGCTTCAGCAAA
GAGTCTATCCTGCCCAAGAGGAACAGCGATAAGCTGATCGCCAGAAAGAA
GGACTGGGACCCTAAGAAGTACGGCGGCTTCGACAGCCCCACCGTGGCCT
ATTCTGTGCTGGTGGTGGCCAAAGTGGAAAAGGGCAAGTCCAAGAAACTG
AAGAGTGTGAAAGAGCTGCTGGGGATCACCATCATGGAAAGAAGCAGCTT
CGAGAAGAATCCCATCGACTTTCTGGAAGCCAAGGGCTACAAAGAAGTGA
AAAAGGACCTGATCATCAAGCTGCCTAAGTACTCCCTGTTCGAGCTGGAA
AACGGCCGGAAGAGAATGCTGGCCTCTGCCGGCGAACTGCAGAAGGGAAA
CGAACTGGCCCTGCCCTCCAAATATGTGAACTTCCTGTACCTGGCCAGCC
ACTATGAGAAGCTGAAGGGCTCCCCCGAGGATAATGAGCAGAAACAGCTG
TTTGTGGAACAGCACAAGCACTACCTGGACGAGATCATCGAGCAGATCAG
CGAGTTCTCCAAGAGAGTGATCCTGGCCGACGCTAATCTGGACAAAGTGC
TGTCCGCCTACAACAAGCACCGGGATAAGCCCATCAGAGAGCAGGCCGAG
AATATCATCCACCTGTTTACCCTGACCAATCTGGGAGCCCCTGCCGCCTT
CAAGTACTTTGACACCACCATCGACCGGAAGAGGTACACCAGCACCAAAG
AGGTGCTGGACGCCACCCTGATCCACCAGAGCATCACCGGCCTGTACGAG
ACACGGATCGACCTGTCTCAGCTGGGAGGCGACagcgctGGAGGAGGTGG
AAGCGGAGGAGGAGGAAGCGGAGGAGGAGGTAGCggacctaagaaaaaga
ggaaggtggcggccgctg
``` pSAMca056 dCas9(G533-P65, 1XGS) - AA
(SEQ ID NO: 202)
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGGGGGSPSGQISNQALALA
PSSAPVLAQTMVPSSAMVPLAQPPAPAPVLTPGPPQSLSAPVPKSTQAGE

-continued

GTLSEALLHLQFDADEDLGALLGNSTDPGVFTDLASVDNSEFQQLLNQGV
SMSHSTAEPMLMEYPEAITRLVTGSQRPPDPAPTPLGTSGLPNGLSGDED
FSSIADMDFSALLSQISSSGQGGGGSMRKPAFLSGEQKKAIVDLLFKTNR
KVTVKQLKEDYFKKIECFDSVEISGVEDRFNASLGTYHDLLKIIKDKDFL
DNEENEDILEDIVLTLTLFEDREMIEERLKTYAHLFDDKVMKQLKRRRYT
GWGRLSRKLINGIRDKQSGKTILDFLKSDGFANRNFMQLIHDDSLTFKED
IQKAQVSGQGDSLHEHIANLAGSPAIKKGILQTVKVVDELVKVMGRHKPE
NIVIEMARENQTTQKGQKNSRERMKRIEEGIKELGSQILKEHPVENTQLQ
NEKLYLYYLQNGRDMYVDQELDINRLSDYDVDAIVPQSFLKDDSIDNKVL
TRSDKNRGKSDNVPSEEVVKKMKNYWRQLLNAKLITQRKFDNLTKAERGG
LSELDKAGFIKRQLVETRQITKHVAQILDSRMNTKYDENDKLIREVKVIT
LKSKLVSDFRKDFQFYKVREINNYHHAHDAYLNAVVGTALIKKYPKLESE
FVYGDYKVYDVRKMIAKSEQEIGKATAKYFFYSNIMNFFKTEITLANGEI
RKRPLIETNGETGEIVWDKGRDFATVRKVLSMPQVNIVKKTEVQTGGFSK
ESILPKRNSDKLIARKKDWDPKKYGGFDSPTVAYSVLVVAKVEKGKSKKL
KSVKELLGITIMERSSFEKNPIDFLEAKGYKEVKKDLIIKLPKYSLFELE
NGRKRMLASAGELQKGNELALPSKYVNFLYLASHYEKLKGSPEDNEQKQL
FVEQHKHYLDEIIEQISEFSKRVILADANLDKVLSAYNKHRDKPIREQAE
NIIHLFTLTNLGAPAAFKYFDTTIDRKRYTSTKEVLDATLIHQSITGLYE
TRIDLSQLGGDSAGGGGSGGGGSGGGGSGPKKKRKVAAA pSAMca057 dCas9(G533-P65, 3XGS) - DNA
(SEQ ID NO: 203)
GgccaccatgGACAAGAAGTACAGCATCGGCCTGGCCATCGGCACCAACT
CTGTGGGCTGGGCCGTGATCACCGACGAGTACAAGGTGCCCAGCAAGAAA
TTCAAGGTGCTGGGCAACACCGACCGGCACAGCATCAAGAAGAACCTGAT
CGGAGCCCTGCTGTTCGACAGCGGCGAAACAGCCGAGGCCACCCGGCTGA
AGAGAACCGCCAGAAGAAGATACACCAGACGGAAGAACCGGATCTGCTAT
CTGCAAGAGATCTTCAGCAACGAGATGGCCAAGGTGGACGACAGCTTCTT
CCACAGACTGGAAGAGTCCTTCCTGGTGGAAGAGGATAAGAAGCACGAGC
GGCACCCCATCTTCGGCAACATCGTGGACGAGGTGGCCTACCACGAGAAG
TACCCCACCATCTACCACCTGAGAAAGAAACTGGTGGACAGCACCGACAA
GGCCGACCTGCGGCTGATCTATCTGGCCCTGGCCCACATGATCAAGTTCC
GGGGCCACTTCCTGATCGAGGGCGACCTGAACCCCGACAACAGCGACGTG
GACAAGCTGTTCATCCAGCTGGTGCAGACCTACAACCAGCTGTTCGAGGA
AAACCCCATCAACGCCAGCGGCGTGGACGCCAAGGCCATCCTGTCTGCCA
GACTGAGCAAGAGCAGACGGCTGGAAAATCTGATCGCCCAGCTGCCCGGC
GAGAAGAAGAATGGCCTGTTCGGCAACCTGATTGCCCTGAGCCTGGGCCT
GACCCCCAACTTCAAGAGCAACTTCGACCTGGCCGAGGATGCCAAACTGC
AGCTGAGCAAGGACACCTACGACGACGACCTGGACAACCTGCTGGCCCAG
ATCGGCGACCAGTACGCCGACCTGTTTCTGGCCGCCAAGAACCTGTCCGA
CGCCATCCTGCTGAGCGACATCCTGAGAGTGAACACCGAGATCACCAAGG
CCCCCCTGAGCGCCTCTATGATCAAGAGATACGACGAGCACCACCAGGAC -continued CTGACCCTGCTGAAAGCTCTCGTGCGGCAGCAGCTGCCTGAGAAGTACAA
AGAGATTTTCTTCGACCAGAGCAAGAACGGCTACGCCGGCTACATTGACG
GCGGAGCCAGCCAGGAAGAGTTCTACAAGTTCATCAAGCCCATCCTGGAA
AAGATGGACGGCACCGAGGAACTGCTCGTGAAGCTGAACAGAGAGGACCT
GCTGCGGAAGCAGCGGACCTTCGACAACGGCAGCATCCCCCACCAGATCC
ACCTGGGAGAGCTGCACGCCATTCTGCGGCGGCAGGAAGATTTTTACCCA
TTCCTGAAGGACAACCGGGAAAAGATCGAGAAGATCCTGACCTTCCGCAT
CCCCTACTACGTGGGCCCTCTGGCCAGGGGAAACAGCAGATTCGCCTGGA
TGACCAGAAAGAGCGAGGAAACCATCACCCCCTGGAACTTCGAGGAAGTG
GTGGACAAGGGCGCTTCCGCCCAGAGCTTCATCGAGCGGATGACCAACTT
CGATAAGAACCTGCCCAACGAGAAGGTGCTGCCCAAGCACAGCCTGCTGT
ACGAGTACTTCACCGTGTATAACGAGCTGACCAAAGTGAAATACGTGACC
GAGGGAGGCGGGGAGGCTCCGGTGGTGGGGGCAGCGGAGGGGGGGCAG
CCCTTCAGGGCAGATCAGCAACCAGGCCCTGGCTCTGGCCCCTAGCTCCG
CTCCAGTGCTGGCCCAGACTATGGTGCCCTCTAGTGCTATGGTGCCTCTG
GCCCAGCCACCTGCTCCAGCCCCTGTGCTGACCCCAGGACCACCCCAGTC
ACTGAGCGCTCCAGTGCCCAAGTCTACACAGGCCGGCGAGGGGACTCTGA
GTGAAGCTCTGCTGCACCTGCAGTTCGACGCTGATGAGGACCTGGGAGCT
CTGCTGGGGAACAGCACCGATCCCGGAGTGTTCACAGATCTGGCCTCCGT
GGACAACTCTGAGTTTCAGCAGCTGCTGAATCAGGGCGTGTCCATGTCTC
ATAGTACAGCCGAACCAATGCTGATGGAGTACCCCGAAGCCATTACCCGG
CTGGTGACCGGCAGCCAGCGGCCCCCCGACCCCGCTCCAACTCCCCTGGG
AACCAGCGGCCTGCCTAATGGGCTGTCCGGAGATGAAGCTTCTCAAGCA
TCGCTGATATGGACTTTAGTGCCCTGCTGTCACAGATTTCCTCTAGTGGG
CAGGGCGGGGAGGCTCCGGTGGTGGGGGCAGCGGAGGGGGGGCAGCAT
GAGAAAGCCCGCCTTCCTGAGCGGCGAGCAGAAAAAGGCCATCGTGGACC
TGCTGTTCAAGACCAACCGGAAAGTGACCGTGAAGCAGCTGAAAGAGGAC
TACTTCAAGAAAATCGAGTGCTTCGACTCCGTGGAAATCTCCGGCGTGGA
AGATCGGTTCAACGCCTCCCTGGGCACATACCACGATCTGCTGAAAATTA
TCAAGGACAAGGACTTCCTGGACAATGAGGAAAACGAGGACATTCTGGAA
GATATCGTGCTGACCCTGACACTGTTTGAGGACAGAGAGATGATCGAGGA
ACGGCTGAAAACCTATGCCCACCTGTTCGACGACAAAGTGATGAAGCAGC
TGAAGCGGCGGAGATACACCGGCTGGGGCAGGCTGAGCCGGAAGCTGATC
AACGGCATCCGGGACAAGCAGTCCGGCAAGACAATCCTGGATTTCCTGAA
GTCCGACGGCTTCGCCAACAGAAACTTCATGCAGCTGATCCACGACGACA
GCCTGACCTTTAAAGAGGACATCCAGAAAGCCCAGGTGTCCGGCCAGGGC
GATAGCCTGCACGAGCACATTGCCAATCTGGCCGGCAGCCCCGCCATTAA
GAAGGGCATCCTGCAGACAGTGAAGGTGGTGGACGAGCTCGTGAAAGTGA
TGGGCCGGCACAAGCCCGAGAACATCGTGATCGAAATGGCCAGAGAGAAC
CAGACCACCCAGAAGGGACAGAAGAACAGCCGCGAGAGAATGAAGCGGAT -continued

```
CGAAGAGGGCATCAAAGAGCTGGGCAGCCAGATCCTGAAAGAACACCCCG
TGGAAAACACCCAGCTGCAGAACGAGAAGCTGTACCTGTACTACCTGCAG
AATGGGCGGGATATGTACGTGGACCAGGAACTGGACATCAACCGGCTGTC
CGACTACGATGTGGACgcTATCGTGCCTCAGAGCTTTCTGAAGGACGACT
CCATCGACAACAAGGTGCTGACCAGAAGCGACAAGAACCGGGGCAAGAGC
GACAACGTGCCCTCCGAAGAGGTCGTGAAGAAGATGAAGAACTACTGGCG
GCAGCTGCTGAACGCCAAGCTGATTACCCAGAGAAAGTTCGACAATCTGA
CCAAGGCCGAGAGAGGCGGCCTGAGCGAACTGGATAAGGCCGGCTTCATC
AAGAGACAGCTGGTGGAAACCCGGCAGATCACAAAGCACGTGGCACAGAT
CCTGGACTCCCGGATGAACACTAAGTACGACGAGAATGACAAGCTGATCC
GGGAAGTGAAAGTGATCACCCTGAAGTCCAAGCTGGTGTCCGATTTCCGG
AAGGATTTCCAGTTTTACAAAGTGCGCGAGATCAACAACTACCACCACGC
CCACGACGCCTACCTGAACGCCGTCGTGGGAACCGCCCTGATCAAAAAGT
ACCCTAAGCTGGAAAGCGAGTTCGTGTACGGCGACTACAAGGTGTACGAC
GTGCGGAAGATGATCGCCAAGAGCGAGCAGGAAATCGGCAAGGCTACCGC
CAAGTACTTCTTCTACAGCAACATCATGAACTTTTTCAAGACCGAGATTA
CCCTGGCCAACGGCGAGATCCGGAAGCGGCCTCTGATCGAGACAAACGGC
GAAACCGGGGAGATCGTGTGGGATAAGGGCCGGGATTTTGCCACCGTGCG
GAAAGTGCTGAGCATGCCCCAAGTGAATATCGTGAAAAAGACCGAGGTGC
AGACAGGCGGCTTCAGCAAAGAGTCTATCCTGCCCAAGAGGAACAGCGAT
AAGCTGATCGCCAGAAAGAAGGACTGGGACCCTAAGAAGTACGGCGGCTT
CGACAGCCCCACCGTGGCCTATTCTGTGCTGGTGGTGGCCAAAGTGGAAA
AGGGCAAGTCCAAGAAACTGAAGAGTGTGAAAGAGCTGCTGGGGATCACC
ATCATGGAAAGAAGCAGCTTCGAAGAATCCCATCGACTTTCTGGAAGC
CAAGGGCTACAAAGAAGTGAAAAAGGACCTGATCATCAAGCTGCCTAAGT
ACTCCCTGTTCGAGCTGGAAAACGGCCGGAAGAGAATGCTGGCCTCTGCC
GGCGAACTGCAGAAGGGAAACGAACTGGCCCTGCCCTCCAAATATGTGAA
CTTCCTGTACCTGGCCAGCCACTATGAGAAGCTGAAGGGCTCCCCCGAGG
ATAATGAGCAGAAACAGCTGTTTGTGGAACAGCACAAGCACTACCTGGAC
GAGATCATCGAGCAGATCAGCGAGTTCTCCAAGAGAGTGATCCTGGCCGA
CGCTAATCTGGACAAAGTGCTGTCCGCCTACAACAAGCACCGGGATAAGC
CCATCAGAGAGCAGGCCGAGAATATCATCCACCTGTTTACCCTGACCAAT
CTGGGAGCCCCTGCCGCCTTCAAGTACTTTGACACCACCATCGACCGGAA
GAGGTACACCAGCACCAAAGAGGTGCTGGACGCCACCCTGATCCACCAGA
GCATCACCGGCCTGTACGAGACACGGATCGACCTGTCTCAGCTGGGAGGC
GACAgcgctGGAGGAGGTGGAAGCGGAGGAGGAGGAAGCGGAGGAGGAGG
TAGCGgaccta a gaaaaagaggaaggtggcggccgctgctagcGGCAGTG
GA
``` pSAMca057 dCas9(G533-P65, 3XGS) - AA
(SEQ ID NO: 204)
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGGGGSGGGGSGGGGSPSG
QISNQALALAPSSAPVLAQTMVPSSAMVPLAQPPAPAPVLTPGPPQSLSA
PVPKSTQAGEGTLSEALLHLQFDADEDLGALLGNSTDPGVFTDLASVDNS
EFQQLLNQGVSMSHSTAEPMLMEYPEAITRLVTGSQRPPDPAPTPLGTSG
LPNGLSGDEDFSSIADMDFSALLSQISSSGQGGGGSGGGGSGGGGSMRKP
AFLSGEQKKAIVDLLFKTNRKVTVKQLKEDYFKKIECFDSVEISGVEDRF
NASLGTYHDLLKIIKDKDFLDNEENEDILEDIVLTLTLFEDREMIEERLK
TYAHLFDDKVMKQLKRRRYTGWGRLSRKLINGIRDKQSGKTILDFLKSDG
FANRNFMQLIHDDSLTFKEDIQKAQVSGQGDSLHEHIANLAGSPAIKKGI
LQTVKVVDELVKVMGRHKPENIVIEMARENQTTQKGQKNSRERMKRIEEG
IKELGSQILKEHPVENTQLQNEKLYLYYLQNGRDMYVDQELDINRLSDYD
VDAIVPQSFLKDDSIDNKVLTRSDKNRGKSDNVPSEEVVKKMKNYWRQLL
NAKLITQRKFDNLTKAERGGLSELDKAGFIKRQLVETRQITKHVAQILDS
RMNTKYDENDKLIREVKVITLKSKLVSDFRKDFQFYKVREINNYHHAHDA
YLNAVVGTALIKKYPKLESEFVYGDYKVYDVRKMIAKSEQEIGKATAKYF
FYSNIMNFFKTEITLANGEIRKRPLIETNGETGEIVWDKGRDFATVRKVL
SMPQVNIVKKTEVQTGGFSKESILPKRNSDKLIARKKDWDPKKYGGFDSP
TVAYSVLVVAKVEKGKSKKLKSVKELLGITIMERSSFEKNPIDFLEAKGY
KEVKKDLIIKLPKYSLFELENGRKRMLASAGELQKGNELALPSKYVNFLY
LASHYEKLKGSPEDNEQKQLFVEQHKHYLDEIIEQISEFSKRVILADANL
DKVLSAYNKHRDKPIREQAENIIHLFTLTNLGAPAAFKYFDTTIDRKRYT
STKEVLDATLIHQSITGLYETRIDLSQLGGDSAGGGGSGGGGSGGGGSGP
KKKRKVAAASGS pSAMca058 dCas9(F575-vp64, 1XGS) - DNA
(SEQ ID NO: 205)
GACAAGAAGTACAGCATCGGCCTGGCCATCGGCACCAACTCTGTGGGCTG
GGCCGTGATCACCGACGAGTACAAGGTGCCCAGCAAGAAATTCAAGGTGC
TGGGCAACACCGACCGGCACAGCATCAAGAAGAACCTGATCGGAGCCCTG
CTGTTCGACAGCGGCGAAACAGCCGAGGCCACCCGGCTGAAGAGAACCGC
CAGAAGAAGATACACCAGACGGAAGAACCGGATCTGCTATCTGCAAGAGA
TCTTCAGCAACGAGATGGCCAAGGTGGACGACAGCTTCTTCCACAGACTG
GAAGAGTCCTTCCTGGTGGAAGAGGATAAGAAGCACGAGCGGCACCCCAT
CTTCGGCAACATCGTGGACGAGGTGGCCTACCACGAGAAGTACCCCACCA
```

-continued

TCTACCACCTGAGAAAGAAACTGGTGGACAGCACCGACAAGGCCGACCTG
CGGCTGATCTATCTGGCCCTGGCCCACATGATCAAGTTCCGGGGCCACTT
CCTGATCGAGGGCGACCTGAACCCCGACAACAGCGACGTGGACAAGCTGT
TCATCCAGCTGGTGCAGACCTACAACCAGCTGTTCGAGGAAAACCCCATC
AACGCCAGCGGCGTGGACGCCAAGGCCATCCTGTCTGCCAGACTGAGCAA
GAGCAGACGGCTGGAAAATCTGATCGCCCAGCTGCCCGGCGAGAAGAAGA
ATGGCCTGTTCGGCAACCTGATTGCCCTGAGCCTGGGCCTGACCCCCAAC
TTCAAGAGCAACTTCGACCTGGCCGAGGATGCCAAACTGCAGCTGAGCAA
GGACACCTACGACGACGACCTGGACAACCTGCTGGCCCAGATCGGCGACC
AGTACGCCGACCTGTTTCTGGCCGCCAAGAACCTGTCCGACGCCATCCTG
CTGAGCGACATCCTGAGAGTGAACACCGAGATCACCAAGGCCCCCCTGAG
CGCCTCTATGATCAAGAGATACGACGAGCACCACCAGGACCTGACCCTGC
TGAAAGCTCTCGTGCGGCAGCAGCTGCCTGAGAAGTACAAAGAGATTTTC
TTCGACCAGAGCAAGAACGGCTACGCCGGCTACATTGACGGCGGAGCCAG
CCAGGAAGAGTTCTACAAGTTCATCAAGCCCATCCTGGAAAAGATGGACG
GCACCGAGGAACTGCTCGTGAAGCTGAACAGAGAGGACCTGCTGCGGAAG
CAGCGGACCTTCGACAACGGCAGCATCCCCCACCAGATCCACCTGGGAGA
GCTGCACGCCATTCTGCGGCGGCAGGAAGATTTTTACCCATTCCTGAAGG
ACAACCGGGAAAAGATCGAGAAGATCCTGACCTTCCGCATCCCCTACTAC
GTGGGCCCTCTGGCCAGGGGAAACAGCAGATTCGCCTGGATGACCAGAAA
GAGCGAGGAAACCATCACCCCCTGGAACTTCGAGGAAGTGGTGGACAAGG
GCGCTTCCGCCCAGAGCTTCATCGAGCGGATGACCAACTTCGATAAGAAC
CTGCCCAACGAGAAGGTGCTGCCCAAGCACAGCCTGCTGTACGAGTACTT
CACCGTGTATAACGAGCTGACCAAAGTGAAATACGTGACCGAGGGAATGA
GAAAGCCCGCCTTCCTGAGCGGCGAGCAGAAAAAGGCCATCGTGGACCTG
CTGTTCAAGACCAACCGGAAAGTGACCGTGAAGCAGCTGAAAGAGGACTA
CTTCAAGAAAATCGAGTGCTTCGACGGGGAGGCAGCGGACGGGCTGACG
CATTGGACGATTTTGATCTGGATATGCTGGGAAGTGACGCCCTCGATGAT
TTTGACCTTGACATGCTTGGTTCGGATGCCCTTGATGACTTTGACCTCGA
CATGCTCGGCAGTGACGCCCTTGATGATTTCGACCTGGACATGCTGATTA
ACGGCGGGGAGGCTCCGACTCCGTGGAAATCTCCGCGCTGGAAGATCGG
TTCAACGCCTCCCTGGGCACATACCACGATCTGCTGAAAATTATCAAGGA
CAAGGACTTCCTGGACAATGAGGAAAACGAGGACATTCTGGAAGATATCG
TGCTGACCCTGACACTGTTTGAGGACAGAGAGATGATCGAGGAACGGCTG
AAAACCTATGCCCACCTGTTCGACGACAAAGTGATGAAGCAGCTGAAGCG
GCGGAGATACACCGGCTGGGGCAGGCTGAGCCGGAAGCTGATCAACGGCA
TCCGGGACAAGCAGTCCGGCAAGACAATCCTGGATTTCCTGAAGTCCGAC
GGCTTCGCCAACAGAAACTTCATGCAGCTGATCCACGACGACAGCCTGAC
CTTTAAAGAGGACATCCAGAAAGCCCAGGTGTCCGGCCAGGGCGATAGCC
TGCACGAGCACATTGCCAATCTGGCCGGCAGCCCCGCCATTAAGAAGGGC
ATCCTGCAGACAGTGAAGGTGGTGGACGAGCTCGTGAAAGTGATGGGCCG

-continued

GCACAAGCCCGAGAACATCGTGATCGAAATGGCCAGAGAGAACCAGACCA
CCCAGAAGGGACAGAAGAACAGCCGCGAGAGAATGAAGCGGATCGAAGAG
GGCATCAAAGAGCTGGGCAGCCAGATCCTGAAAGAACACCCCGTGGAAAA
CACCCAGCTGCAGAACGAGAAGCTGTACCTGTACTACCTGCAGAATGGGC
GGGATATGTACGTGGACCAGGAACTGGACATCAACCGGCTGTCCGACTAC
GATGTGGACgcTATCGTGCCTCAGAGCTTTCTGAAGGACGACTCCATCGA
CAACAAGGTGCTGACCAGAAGCGACAAGAACCGGGGCAAGAGCGACAACG
TGCCCTCCGAAGAGGTCGTGAAGAAGATGAAGAACTACTGGCGGCAGCTG
CTGAACGCCAAGCTGATTACCCAGAGAAAGTTCGACAATCTGACCAAGGC
CGAGAGAGGCGGCCTGAGCGAACTGGATAAGGCCGGCTTCATCAAGAGAC
AGCTGGTGGAAACCCGGCAGATCACAAAGCACGTGGCACAGATCCTGGAC
TCCCGGATGAACACTAAGTACGACGAGAATGACAAGCTGATCCGGGAAGT
GAAAGTGATCACCCTGAAGTCCAAGCTGGTGTCCGATTTCCGGAAGGATT
TCCAGTTTTACAAAGTGCGCGAGATCAACAACTACCACCACGCCCACGAC
GCCTACCTGAACGCCGTCGTGGGAACCGCCCTGATCAAAAAGTACCCTAA
GCTGGAAAGCGAGTTCGTGTACGGCGACTACAAGGTGTACGACGTGCGGA
AGATGATCGCCAAGAGCGAGCAGGAAATCGGCAAGGCTACCGCCAAGTAC
TTCTTCTACAGCAACATCATGAACTTTTTCAAGACCGAGATTACCCTGGC
CAACGGCGAGATCCGGAAGCGGCCTCTGATCGAGACAAACGGCGAAACCG
GGGAGATCGTGTGGGATAAGGGCCGGGATTTTGCCACCGTGCGGAAAGTG
CTGAGCATGCCCCAAGTGAATATCGTGAAAAAGACCGAGGTGCAGACAGG
CGGCTTCAGCAAAGAGTCTATCCTGCCCAAGAGGAACAGCGATAAGCTGA
TCGCCAGAAAGAAGGACTGGGACCCTAAGAAGTACGGCGGCTTCGACAGC
CCCACCGTGGCCTATTCTGTGCTGGTGGTGGCCAAAGTGGAAAAGGGCAA
GTCCAAGAAACTGAAGAGTGTGAAAGAGCTGCTGGGGATCACCATCATGG
AAAGAAGCAGCTTCGAGAAGAATCCCATCGACTTTCTGGAAGCCAAGGGC
TACAAAGAAGTGAAAAAGGACCTGATCATCAAGCTGCCTAAGTACTCCCT
GTTCGAGCTGGAAAACGGCCGGAAGAGAATGCTGGCCTCTGCCGGCGAAC
TGCAGAAGGGAAACGAACTGGCCCTGCCCTCCAAATATGTGAACTTCCTG
TACCTGGCCAGCCACTATGAGAAGCTGAAGGGCTCCCCCGAGGATAATGA
GCAGAAACAGCTGTTTGTGGAACAGCACAAGCACTACCTGGACGAGATCA
TCGAGCAGATCAGCGAGTTCTCCAAGAGAGTGATCCTGGCCGACGCTAAT
CTGGACAAAGTGCTGTCCGCCTACAACAAGCACCGGGATAAGCCCATCAG
AGAGCAGGCCGAGAATATCATCCACCTGTTTACCCTGACCAATCTGGGAG
CCCCTGCCGCCTTCAAGTACTTTGACACCACCATCGACCGGAAGAGGTAC
ACCAGCACCAAAGAGGTGCTGGACGCCACCCTGATCCACCAGAGCATCAC
CGGCCTGTACGAGACACGGATCGACCTGTCTCAGCTGGGAGGCGACagcg
ctGGAGGAGGTGGAAGCGGAGGAGGAGGAAGCGGAGGAGGAGGTAGCgga
cctaagaaaaagaggaaggtggcg pSAMca058 dCas9(F575-vp64, 1XGS) - AA
(SEQ ID NO: )
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFGGGGSGRADALDDFDLDMLGSDALDD
FDLDMLGSDALDDFDLDMLGSDALDDFDLDMLINGGGGSDSVEISGVEDR
FNASLGTYHDLLKIIKDKDFLDNEENEDILEDIVLTLTLFEDREMIEERL
KTYAHLFDDKVMKQLKRRRYTGWGRLSRKLINGIRDKQSGKTILDFLKSD
GFANRNFMQLIHDDSLTFKEDIQKAQVSGQGDSLHEHIANLAGSPAIKKG
ILQTVKVVDELVKVMGRHKPENIVIEMARENQTTQKGQKNSRERMKRIEE
GIKELGSQILKEHPVENTQLQNEKLYLYYLQNGRDMYVDQELDINRLSDY
DVDAIVPQSFLKDDSIDNKVLTRSDKNRGKSDNVPSEEVVKKMKNYWRQL
LNAKLITQRKFDNLTKAERGGLSELDKAGFIKRQLVETRQITKHVAQILD
SRMNTKYDENDKLIREVKVITLKSKLVSDFRKDFQFYKVREINNYHHAHD
AYLNAVVGTALIKKYPKLESEFVYGDYKVYDVRKMIAKSEQEIGKATAKY
FFYSNIMNFFKTEITLANGEIRKRPLIETNGETGEIVWDKGRDFATVRKV
LSMPQVNIVKKTEVQTGGFSKESILPKRNSDKLIARKKDWDPKKYGGFDS
PTVAYSVLVVAKVEKGKSKKLKSVKELLGITIMERSSFEKNPIDFLEAKG
YKEVKKDLIIKLPKYSLFELENGRKRMLASAGELQKGNELALPSKYVNFL
YLASHYEKLKGSPEDNEQKQLFVEQHKHYLDEIIEQISEFSKRVILADAN
LDKVLSAYNKHRDKPIREQAENIIHLFTLTNLGAPAAFKYFDTTIDRKRY
TSTKEVLDATLIHQSITGLYETRIDLSQLGGDSAGGGGSGGGGSGGGGSG
PKKKRKVA pSAMca059 dCas9(F575-vp64, 3XGS) - DNA
(SEQ ID NO: 207)
CAGCATCGGCCTGGCCATCGGCACCAACTCTGTGGGCTGGGCCGTGATCA
CCGACGAGTACAAGGTGCCCAGCAAGAAATTCAAGGTGCTGGGCAACACC
GACCGGCACAGCATCAAGAAGAACCTGATCGGAGCCCTGCTGTTCGACAG
CGGCGAAACAGCCGAGGCCACCCGGCTGAAGAGAACCGCCAGAAGAAGAT
ACACCAGACGGAAGAACCGGATCTGCTATCTGCAAGAGATCTTCAGCAAC
GAGATGGCCAAGGTGGACGACAGCTTCTTCCACAGACTGGAAGAGTCCTT
CCTGGTGGAAGAGGATAAGAAGCACGAGCGGCACCCCATCTTCGGCAACA
TCGTGGACGAGGTGGCCTACCACGAGAAGTACCCCACCATCTACCACCTG
AGAAAGAAACTGGTGGACAGCACCGACAAGGCCGACCTGCGGCTGATCTA
TCTGGCCCTGGCCCACATGATCAAGTTCCGGGGCCACTTCCTGATCGAGG
GCGACCTGAACCCCGACAACAGCGACGTGGACAAGCTGTTCATCCAGCTG
GTGCAGACCTACAACCAGCTGTTCGAGGAAAACCCCATCAACGCCAGCGG
CGTGGACGCCAAGGCCATCCTGTCTGCCAGACTGAGCAAGAGCAGACGGC
TGGAAAATCTGATCGCCCAGCTGCCCGGCGAGAAGAAGAATGGCCTGTTC
GGCAACCTGATTGCCCTGAGCCTGGGCCTGACCCCCAACTTCAAGAGCAA
CTTCGACCTGGCCGAGGATGCCAAACTGCAGCTGAGCAAGGACACCTACG
ACGACGACCTGGACAACCTGCTGGCCCAGATCGGCGACCAGTACGCCGAC
CTGTTTCTGGCCGCCAAGAACCTGTCCGACGCCATCCTGCTGAGCGACAT
CCTGAGAGTGAACACCGAGATCACCAAGGCCCCCCTGAGCGCCTCTATGA
TCAAGAGATACGACGAGCACCACCAGGACCTGACCCTGCTGAAAGCTCTC
GTGCGGCAGCAGCTGCCTGAGAAGTACAAAGAGATTTTCTTCGACCAGAG
CAAGAACGGCTACGCCGGCTACATTGACGGCGGAGCCAGCCAGGAAGAGT
TCTACAAGTTCATCAAGCCCATCCTGGAAAAGATGGACGGCACCGAGGAA
CTGCTCGTGAAGCTGAACAGAGAGGACCTGCTGCGGAAGCAGCGGACCTT
CGACAACGGCAGCATCCCCCACCAGATCCACCTGGGAGAGCTGCACGCCA
TTCTGCGGCGGCAGGAAGATTTTTACCCATTCCTGAAGGACAACCGGGAA
AAGATCGAGAAGATCCTGACCTTCCGCATCCCCTACTACGTGGGCCCTCT
GGCCAGGGGAAACAGCAGATTCGCCTGGATGACCAGAAAGAGCGAGGAAA
CCATCACCCCCTGGAACTTCGAGGAAGTGGTGGACAAGGGCGCTTCCGCC
CAGAGCTTCATCGAGCGGATGACCAACTTCGATAAGAACCTGCCCAACGA
GAAGGTGCTGCCCAAGCACAGCCTGCTGTACGAGTACTTCACCGTGTATA
ACGAGCTGACCAAAGTGAAATACGTGACCGAGGGAATGAGAAAGCCCGCC
TTCCTGAGCGGCGAGCAGAAAAAGGCCATCGTGGACCTGCTGTTCAAGAC
CAACCGGAAAGTGACCGTGAAGCAGCTGAAAGAGGACTACTTCAAGAAAA
TCGAGTGCTTCGGCGGGGAGGCTCCGGTGGTGGGGCAGCGGAGGGGGG
GGCAGCGGACGGGCTGACGCATTGGACGATTTTGATCTGGATATGCTGGG
AAGTGACGCCCTCGATGATTTTGACCTTGACATGCTTGGTTCGGATGCCC
TTGATGACTTTGACCTCGACATGCTCGGCAGTGACGCCCTTGATGATTTC
GACCTGGACATGCTGATTAACGGCGGGGAGGCTCCGGTGGTGGGGCAG
CGGAGGGGGGGGCAGCGACTCCGTGGAAATCTCCGGCGTGGAAGATCGGT
TCAACGCCTCCCTGGGCACATACCACGATCTGCTGAAAATTATCAAGGAC
AAGGACTTCCTGGACAATGAGGAAAACGAGGACATTCTGGAAGATATCGT
GCTGACCCTGACACTGTTTGAGGACAGAGAGATGATCGAGGAACGGCTGA
AAACCTATGCCCACCTGTTCGACGACAAAGTGATGAAGCAGCTGAAGCGG
CGGAGATACACCGGCTGGGGCAGGCTGAGCCGGAAGCTGATCAACGGCAT
CCGGGACAAGCAGTCCGGCAAGACAATCCTGGATTTCCTGAAGTCCGACG
GCTTCGCCAACAGAAACTTCATGCAGCTGATCCACGACGACAGCCTGACC
TTTAAAGAGGACATCCAGAAAGCCCAGGTGTCCGGCCAGGGCGATAGCCT
GCACGAGCACATTGCCAATCTGGCCGGCAGCCCCGCCATTAAGAAGGGCA

```
TCCTGCAGACAGTGAAGGTGGTGGACGAGCTCGTGAAAGTGATGGGCCGG
CACAAGCCCGAGAACATCGTGATCGAAATGGCCAGAGAGAACCAGACCAC
CCAGAAGGGACAGAAGAACAGCCGCGAGAGAATGAAGCGGATCGAAGAGG
GCATCAAAGAGCTGGGCAGCCAGATCCTGAAAGAACACCCCGTGGAAAAC
ACCCAGCTGCAGAACGAGAAGCTGTACCTGTACTACCTGCAGAATGGGCG
GGATATGTACGTGGACCAGGAACTGGACATCAACCGGCTGTCCGACTACG
ATGTGGACgcTATCGTGCCTCAGAGCTTTCTGAAGGACGACTCCATCGAC
AACAAGGTGCTGACCAGAAGCGACAAGAACCGGGGCAAGAGCGACAACGT
GCCCTCCGAAGAGGTCGTGAAGAAGATGAAGAACTACTGGCGGCAGCTGC
TGAACGCCAAGCTGATTACCCAGAGAAAGTTCGACAATCTGACCAAGGCC
GAGAGAGGCGGCCTGAGCGAACTGGATAAGGCCGGCTTCATCAAGAGACA
GCTGGTGGAAACCCGGCAGATCACAAAGCACGTGGCACAGATCCTGGACT
CCCGGATGAACACTAAGTACGACGAGAATGACAAGCTGATCCGGGAAGTG
AAAGTGATCACCCTGAAGTCCAAGCTGGTGTCCGATTTCCGGAAGGATTT
CCAGTTTTACAAAGTGCGCGAGATCAACAACTACCACCACGCCCACGACG
CCTACCTGAACGCCGTCGTGGGAACCGCCCTGATCAAAAAGTACCCTAAG
CTGGAAAGCGAGTTCGTGTACGGCGACTACAAGGTGTACGACGTGCGGAA
GATGATCGCCAAGAGCGAGCAGGAAATCGGCAAGGCTACCGCCAAGTACT
TCTTCTACAGCAACATCATGAACTTTTTCAAGACCGAGATTACCCTGGCC
AACGGCGAGATCCGGAAGCGGCCTCTGATCGAGACAAACGGCGAAACCGG
GGAGATCGTGTGGGATAAGGGCCGGGATTTTGCCACCGTGCGGAAAGTGC
TGAGCATGCCCCAAGTGAATATCGTGAAAAAGACCGAGGTGCAGACAGGC
GGCTTCAGCAAAGAGTCTATCCTGCCCAAGAGGAACAGCGATAAGCTGAT
CGCCAGAAAGAAGGACTGGGACCCTAAGAAGTACGGCGGCTTCGACAGCC
CCACCGTGGCCTATTCTGTGCTGGTGGTGGCCAAAGTGGAAAAGGGCAAG
TCCAAGAAACTGAAGAGTGTGAAAGAGCTGCTGGGGATCACCATCATGGA
AAGAAGCAGCTTCGAGAAGAATCCCATCGACTTTCTGGAAGCCAAGGGCT
ACAAAGAAGTGAAAAAGGACCTGATCATCAAGCTGCCTAAGTACTCCCTG
TTCGAGCTGGAAAACGGCCGGAAGAGAATGCTGGCCTCTGCCGGCGAACT
GCAGAAGGGAAACGAACTGGCCCTGCCCTCCAAATATGTGAACTTCCTGT
ACCTGGCCAGCCACTATGAGAAGCTGAAGGGCTCCCCCGAGGATAATGAG
CAGAAACAGCTGTTTGTGGAACAGCACAAGCACTACCTGGACGAGATCAT
CGAGCAGATCAGCGAGTTCTCCAAGAGAGTGATCCTGGCCGACGCTAATC
TGGACAAAGTGCTGTCCGCCTACAACAAGCACCGGGATAAGCCCATCAGA
GAGCAGGCCGAGAATATCATCCACCTGTTTACCCTGACCAATCTGGGAGC
CCCTGCCGCCTTCAAGTACTTTGACACCACCATCGACCGGAAGAGGTACA
CCAGCACCAAAGAGGTGCTGGACGCCACCCTGATCCACCAGAGCATCACC
GGCCTGTACGAGACACGGATCGACCTGTCTCAGCTGGGAGGCGACagcgc
tGGAGGAGGTGGAAGCGGAGGAGGAGGAAGCGGAGGAGGAGGTAGCggac
ctaagaaaaagaggaaggtggcggccgctgctagc
``` pSAMca059 dCas9(F575-vp64, 3XGS) - AA
(SEQ ID NO: 208)
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFGGGGSGGGGSGGGGSGRADALDDFDL
DMLGSDALDDFDLDMLGSDALDDFDLDMLGSDALDDFDLDMLINGGGGSG
GGGSGGGGSDSVEISGVEDRFNASLGTYHDLLKIIKDKDFLDNEENEDIL
EDIVLTLTLFEDREMIEERLKTYAHLFDDKVMKQLKRRRYTGWGRLSRKL
INGIRDKQSGKTILDFLKSDGFANRNFMQLIHDDSLTFKEDIQKAQVSGQ
GDSLHEHIANLAGSPAIKKGILQTVKVVDELVKVMGRHKPENIVIEMARE
NQTTQKGQKNSRERMKRIEEGIKELGSQILKEHPVENTQLQNEKLYLYYL
QNGRDMYVDQELDINRLSDYDVDAIVPQSFLKDDSIDNKVLTRSDKNRGK
SDNVPSEEVVKKMKNYWRQLLNAKLITQRKFDNLTKAERGGLSELDKAGF
IKRQLVETRQITKHVAQILDSRMNTKYDENDKLIREVKVITLKSKLVSDF
RKDFQFYKVREINNYHHAHDAYLNAVVGTALIKKYPKLESEFVYGDYKVY
DVRKMIAKSEQEIGKATAKYFFYSNIMNFFKTEITLANGEIRKRPLIETN
GETGEIVWDKGRDFATVRKVLSMPQVNIVKKTEVQTGGFSKESILPKRNS
DKLIARKKDWDPKKYGGFDSPTVAYSVLVVAKVEKGKSKKLKSVKELLGI
TIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYL
DEIIEQISEFSKRVILADANLDKVLSAYNKHRDKPIREQAENIIHLFTLT
NLGAPAAFKYFDTTIDRKRYTSTKEVLDATLIHQSITGLYETRIDLSQLG
GD pSAMca060 dCas9(F575-P65, 1XGS) - DNA
(SEQ ID NO: 209)
```
GACAAGAAGTACAGCATCGGCCTGGCCATCGGCACCAACTCTGTGGGCTG
GGCCGTGATCACCGACGAGTACAAGGTGCCCAGCAAGAAATTCAAGGTGC
TGGGCAACACCGACCGGCACAGCATCAAGAAGAACCTGATCGGAGCCCTG
CTGTTCGACAGCGGCGAAACAGCCGAGGCCACCCGGCTGAAGAGAACCGC
CAGAAGAAGATACACCAGACGGAAGAACCGGATCTGCTATCTGCAAGAGA
TCTTCAGCAACGAGATGGCCAAGGTGGACGACAGCTTCCACAGACTG
AAGAGTCCTTCCTGGTGGAAGAGGATAAGAAGCACGAGCGGCACCCCAT
CTTCGGCAACATCGTGGACGAGGTGGCCTACCACGAGAAGTACCCCACCA
TCTACCACCTGAGAAAGAAACTGGTGGACAGCACCGACAAGGCCGACCTG
```

```
CGGCTGATCTATCTGGCCCTGGCCCACATGATCAAGTTCCGGGGCCACTT

CCTGATCGAGGGCGACCTGAACCCCGACAACAGCGACGTGGACAAGCTGT

TCATCCAGCTGGTGCAGACCTACAACCAGCTGTTCGAGGAAAACCCCATC

AACGCCAGCGGCGTGGACGCCAAGGCCATCCTGTCTGCCAGACTGAGCAA

GAGCAGACGGCTGGAAAATCTGATCGCCCAGCTGCCCGGCGAGAAGAAGA

ATGGCCTGTTCGGCAACCTGATTGCCCTGAGCCTGGGCCTGACCCCCAAC

TTCAAGAGCAACTTCGACCTGGCCGAGGATGCCAAACTGCAGCTGAGCAA

GGACACCTACGACGACGACCTGGACAACCTGCTGGCCCAGATCGGCGACC

AGTACGCCGACCTGTTTCTGGCCGCCAAGAACCTGTCCGACGCCATCCTG

CTGAGCGACATCCTGAGAGTGAACACCGAGATCACCAAGGCCCCCCTGAG

CGCCTCTATGATCAAGAGATACGACGAGCACCACCAGGACCTGACCCTGC

TGAAAGCTCTCGTGCGGCAGCAGCTGCCTGAGAAGTACAAAGAGATTTTC

TTCGACCAGAGCAAGAACGGCTACGCCGGCTACATTGACGGCGGAGCCAG

CCAGGAAGAGTTCTACAAGTTCATCAAGCCCATCCTGGAAAAGATGGACG

GCACCGAGGAACTGCTCGTGAAGCTGAACAGAGAGGACCTGCTGCGGAAG

CAGCGGACCTTCGACAACGGCAGCATCCCCCACCAGATCCACCTGGGAGA

GCTGCACGCCATTCTGCGGCGGCAGGAAGATTTTTACCCATTCCTGAAGG

ACAACCGGGAAAAGATCGAGAAGATCCTGACCTTCCGCATCCCCTACTAC

GTGGGCCCTCTGGCCAGGGGAAACAGCAGATTCGCCTGGATGACCAGAAA

GAGCGAGGAAACCATCACCCCCTGGAACTTCGAGGAAGTGGTGGACAAGG

GCGCTTCCGCCCAGAGCTTCATCGAGCGGATGACCAACTTCGATAAGAAC

CTGCCCAACGAGAAGGTGCTGCCCAAGCACAGCCTGCTGTACGAGTACTT

CACCGTGTATAACGAGCTGACCAAAGTGAAATACGTGACCGAGGGAATGA

GAAAGCCCGCCTTCCTGAGCGGCGAGCAGAAAAAGGCCATCGTGGACCTG

CTGTTCAAGACCAACCGGAAAGTGACCGTGAAGCAGCTGAAAGAGGACTA

CTTCAAGAAAATCGAGTGCTTCGGAGGGGAGGCAGCCCTTCAGGGCAGA

TCAGCAACCAGGCCCTGGCTCTGGCCCCTAGCTCCGCTCCAGTGCTGGCC

CAGACTATGGTGCCCTCTAGTGCTATGGTGCCTCTGGCCCAGCCACCTGC

TCCAGCCCCTGTGCTGACCCCAGGACCACCCCAGTCACTGAGCGCTCCAG

TGCCCAAGTCTACACAGGCCGGCGAGGGGACTCTGAGTGAAGCTCTGCTG

CACCTGCAGTTCGACGCTGATGAGGACCTGGGAGCTCTGCTGGGGAACAG

CACCGATCCCGGAGTGTTCACAGATCTGGCCTCCGTGGACAACTCTGAGT

TTCAGCAGCTGCTGAATCAGGGCGTGTCCATGTCTCATAGTACAGCCGAA

CCAATGCTGATGGAGTACCCCGAAGCCATTACCCGGCTGGTGACCGGCAG

CCAGCGGCCCCCCGACCCCGCTCCAACTCCCTGGGAACCAGCGGCCTGC

CTAATGGGCTGTCCGGAGATGAAGACTTCTCAAGCATCGCTGATATGGAC

TTTAGTGCCCTGCTGTCACAGATTTCCTCTAGTGGGCAGGGAGGGGGGG

CAGCGACTCCGTGGAAATCTCCGGCGTGGAAGATCGGTTCAACGCCTCCC

TGGGCACATACCACGATCTGCTGAAAATTATCAAGGACAAGGACTTCCTG

GACAATGAGGAAAACGAGGACATTCTGGAAGATATCGTGCTGACCCTGAC
```

```
ACTGTTTGAGGACAGAGAGATGATCGAGGAACGGCTGAAAACCTATGCCC

ACCTGTTCGACGACAAAGTGATGAAGCAGCTGAAGCGGCGGAGATACACC

GGCTGGGGCAGGCTGAGCCGGAAGCTGATCAACGGCATCCGGGACAAGCA

GTCCGGCAAGACAATCCTGGATTTCCTGAAGTCCGACGGCTTCGCCAACA

GAAACTTCATGCAGCTGATCCACGACGACAGCCTGACCTTTAAAGAGGAC

ATCCAGAAAGCCCAGGTGTCCGGCCAGGGCGATAGCCTGCACGAGCACAT

TGCCAATCTGGCCGGCAGCCCCGCCATTAAGAAGGGCATCCTGCAGACAG

TGAAGGTGGTGGACGAGCTCGTGAAAGTGATGGGCCGGCACAAGCCCGAG

AACATCGTGATCGAAATGGCCAGAGAGAACCAGACCACCCAGAAGGGACA

GAAGAACAGCCGCGAGAGAATGAAGCGGATCGAAGAGGGCATCAAAGAGC

TGGGCAGCCAGATCCTGAAAGAACACCCCGTGGAAAACACCCAGCTGCAG

AACGAGAAGCTGTACCTGTACTACCTGCAGAATGGGCGGGATATGTACGT

GGACCAGGAACTGGACATCAACCGGCTGTCCGACTACGATGTGGACgcTA

TCGTGCCTCAGAGCTTTCTGAAGGACGACTCCATCGACAACAAGGTGCTG

ACCAGAAGCGACAAGAACCGGGGCAAGAGCGACAACGTGCCCTCCGAAGA

GGTCGTGAAGAAGATGAAGAACTACTGGCGGCAGCTGCTGAACGCCAAGC

TGATTACCCAGAGAAAGTTCGACAATCTGACCAAGGCCGAGAGAGGCGGC

CTGAGCGAACTGGATAAGGCCGGCTTCATCAAGAGACAGCTGGTGGAAAC

CCGGCAGATCACAAAGCACGTGGCACAGATCCTGGACTCCCGGATGAACA

CTAAGTACGACGAGAATGACAAGCTGATCCGGGAAGTGAAAGTGATCACC

CTGAAGTCCAAGCTGGTGTCCGATTTCCGGAAGGATTTCCAGTTTTACAA

AGTGCGCGAGATCAACAACTACCACCACGCCCACGACGCCTACCTGAACG

CCGTCGTGGGAACCGCCCTGATCAAAAAGTACCCTAAGCTGGAAAGCGAG

TTCGTGTACGGCGACTACAAGGTGTACGACGTGCGGAAGATGATCGCCAA

GAGCGAGCAGGAAATCGGCAAGGCTACCGCCAAGTACTTCTTCTACAGCA

ACATCATGAACTTTTTCAAGACCGAGATTACCCTGGCCAACGGCGAGATC

CGGAAGCGGCCTCTGATCGAGACAAACGGCGAAACCGGGGAGATCGTGTG

GGATAAGGGCCGGGATTTTGCCACCGTGCGGAAAGTGCTGAGCATGCCCC

AAGTGAATATCGTGAAAAAGACCGAGGTGCAGACAGGCGGCTTCAGCAAA

GAGTCTATCCTGCCCAAGAGGAACAGCGATAAGCTGATCGCCAGAAAGAA

GGACTGGGACCCTAAGAAGTACGGCGGCTTCGACAGCCCCACCGTGGCCT

ATTCTGTGCTGGTGGTGGCCAAAGTGGAAAAGGGCAAGTCCAAGAAACTG

AAGAGTGTGAAAGAGCTGCTGGGGATCACCATCATGGAAAGAAGCAGCTT

CGAGAAGAATCCCATCGACTTTCTGGAAGCCAAGGGCTACAAAGAAGTGA

AAAAGGACCTGATCATCAAGCTGCCTAAGTACTCCCTGTTCGAGCTGGAA

AACGGCCGGAAGAGAATGCTGGCCTCTGCCGGCGAACTGCAGAAGGGAAA

CGAACTGGCCCTGCCCTCCAAATATGTGAACTTCCTGTACCTGGCCAGCC

ACTATGAGAAGCTGAAGGGCTCCCCCGAGGATAATGAGCAGAAACAGCTG

TTTGTGGAACAGCACAAGCACTACCTGGACGAGATCATCGAGCAGATCAG

CGAGTTCTCCAAGAGAGTGATCCTGGCCGACGCTAATCTGGACAAAGTGC

TGTCCGCCTACAACAAGCACCGGGATAAGCCCATCAGAGAGCAGGCCGAG
```

-continued

```
AATATCATCCACCTGTTTACCCTGACCAATCTGGGAGCCCCTGCCGCCTT
CAAGTACTTTGACACCACCATCGACCGGAAGAGGTACACCAGCACCAAG
AGGTGCTGGACGCCACCCTGATCCACCAGAGCATCACCGGCCTGTACGAG
ACACGGATCGACCTGTCTCAGCTGGGAGGCGACAgcgctGGAGGAGGTGG
AAGCGGAGGAGGAGGAAGCGGAGGAGGAGGTAGCggacctaagaaaaaga
ggaaggtggcggcc
``` pSAMca060 dCas9(F575-P65, 1XGS) - AA
(SEQ ID NO: 210)

```
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFDSGGGSPSGQISNQALALAPSSAPVLA
QTMVPSSAMVPLAQPPAPAPVLTPGPPQSLSAPVPKSTQAGEGTLSEALL
HLQFDADEDLGALLGNSTDPGVFTDLASVDNSEFQQLLNQGVSMSHSTAE
PMLMEYPEAITRLVTGSQRPPDPAPTPLGTSGLPNGLSGDEDFSSIADMD
FSALLSQISSSGQGGGGSDSVEISGVEDRFNASLGTYHDLLKIIKDKDFL
DNEENEDILEDIVLTLTLFEDREMIEERLKTYAHLFDDKVMKQLKRRRYT
GWGRLSRKLINGIRDKQSGKTILDFLKSDGFANRNFMQLIHDDSLTFKED
IQKAQVSGQGDSLHEHIANLAGSPAIKKGILQTVKVVDELVKVMGRHKPE
NIVIEMARENQTTQKGQKNSRERMKRIEEGIKELGSQILKEHPVENTQLQ
NEKLYLYYLQNGRDMYVDQELDINRLSDYDVDAIVPQSFLKDDSIDNKVL
TRSDKNRGKSDNVPSEEVVKKMKNYWRQLLNAKLITQRKFDNLTKAERGG
LSELDKAGFIKRQLVETRQITKHVAQILDSRMNTKYDENDKLIREVKVIT
LKSKLVSDFRKDFQFYKVREINNYHHAHDAYLNAVVGTALIKKYPKLESE
FVYGDYKVYDVRKMIAKSEQEIGKATAKYFFYSNIMNFFKTEITLANGEI
RKRPLIETNGETGEIVWDKGRDFATVRKVLSMPQVNIVKKTEVQTGGFSK
ESILPKRNSDKLIARKKDWDPKKYGGFDSPTVAYSVLVVAKVEKGKSKKL
KSVKELLGITIMERSSFEKNPIDFLEAKGYKEVKKDLIIKLPKYSLFELE
NGRKRMLASAGELQKGNELALPSKYVNFLYLASHYEKLKGSPEDNEQKQL
FVEQHKYLDEIIEQISEFSKRVILADANLDKVLSAYNKHRDKPIREQAE
NIIHLFTLTNLGAPAAFKYFDTTIDRKRYTSTKEVLDATLIHQSITGLYE
TRIDLSQLGGDSAGGGGSGGGGSGGGGSGPKKKRKVAA
``` pSAMca061 dCas9(F575-P65, 3XGS) - DNA
(SEQ ID NO: 211)

```
accatgGACAAGAAGTACAGCATCGGCCTGGCCATCGGCACCAACTCTGT
GGGCTGGGCCGTGATCACCGACGAGTACAAGGTGCCCAGCAAGAAATTCA
AGGTGCTGGGCAACACCGACCGGCACAGCATCAAGAAGAACCTGATCGGA
GCCCTGCTGTTCGACAGCGGCGAAACAGCCGAGGCCACCCGGCTGAAGAG
AACCGCCAGAAGAAGATACACCAGACGGAAGAACCGGATCTGCTATCTGC
AAGAGATCTTCAGCAACGAGATGGCCAAGGTGGACGACAGCTTCTTCCAC
AGACTGGAAGAGTCCTTCCTGGTGGAAGAGGATAAGAAGCACGAGCGGCA
CCCCATCTTCGGCAACATCGTGGACGAGGTGGCCTACCACGAGAAGTACC
CCACCATCTACCACCTGAGAAAGAAACTGGTGGACAGCACCGACAAGGCC
GACCTGCGGCTGATCTATCTGGCCCTGGCCCACATGATCAAGTTCCGGGG
CCACTTCCTGATCGAGGGCGACCTGAACCCCGACAACAGCGACGTGGACA
AGCTGTTCATCCAGCTGGTGCAGACCTACAACCAGCTGTTCGAGGAAAAC
CCCATCAACGCCAGCGGCGTGGACGCCAAGGCCATCCTGTCTGCCAGACT
GAGCAAGAGCAGACGGCTGGAAAATCTGATCGCCCAGCTGCCCGGCGAGA
AGAAGAATGGCCTGTTCGGCAACCTGATTGCCCTGAGCCTGGGCCTGACC
CCCAACTTCAAGAGCAACTTCGACCTGGCCGAGGATGCCAAACTGCAGCT
GAGCAAGGACACCTACGACGACGACCTGGACAACCTGCTGGCCCAGATCG
GCGACCAGTACGCCGACCTGTTTCTGGCCGCCAAGAACCTGTCCGACGCC
ATCCTGCTGAGCGACATCCTGAGAGTGAACACCGAGATCACCAAGGCCCC
CCTGAGCGCCTCTATGATCAAGAGATACGACGAGCACCACCAGGACCTGA
CCCTGCTGAAAGCTCTCGTGCGGCAGCAGCTGCCTGAGAAGTACAAAGAG
ATTTTCTTCGACCAGAGCAAGAACGGCTACGCCGGCTACATTGACGGCGG
AGCCAGCCAGGAAGAGTTCTACAAGTTCATCAAGCCCATCCTGGAAAAGA
TGGACGGCACCGAGGAACTGCTCGTGAAGCTGAACAGAGAGGACCTGCTG
CGGAAGCAGCGGACCTTCGACAACGGCAGCATCCCCCACCAGATCCACCT
GGGAGAGCTGCACGCCATTCTGCGGCGGCAGGAAGATTTTTACCCATTCC
TGAAGGACAACCGGGAAAAGATCGAGAAGATCCTGACCTTCCGCATCCCC
TACTACGTGGGCCCTCTGGCCAGGGGAAACAGCAGATTCGCCTGGATGAC
CAGAAAGAGCGAGGAAACCATCACCCCCTGGAACTTCGAGGAAGTGGTGG
ACAAGGGCGCTTCCGCCCAGAGCTTCATCGAGCGGATGACCAACTTCGAT
AAGAACCTGCCCAACGAGAAGGTGCTGCCCAAGCACAGCCTGCTGTACGA
GTACTTCACCGTGTATAACGAGCTGACCAAAGTGAAATACGTGACCGAGG
GAATGAGAAAGCCCGCCTTCCTGAGCGGCGAGCAGAAAAAGGCCATCGTG
GACCTGCTGTTCAAGACCAACCGGAAAGTGACCGTGAAGCAGCTGAAAGA
GGACTACTTCAAGAAAATCGAGTGCTTCGGCGGGGAGGCTCCGGTGGTG
GGGGCAGCGGAGGGGGGGCAGCCCTTCAGGGCAGATCAGCAACCAGGCC
CTGGCTCTGGCCCCTAGCTCCGCTCCAGTGCTGGCCCAGACTATGGTGCC
CTCTAGTGCTATGGTGCCTCTGGCCCAGCCACCTGCTCCAGCCCCTGTGC
TGACCCCAGGACCACCCCAGTCACTGAGCGCTCCAGTGCCCAAGTCTACA
```

```
CAGGCCGGCGAGGGGACTCTGAGTGAAGCTCTGCTGCACCTGCAGTTCGA
CGCTGATGAGGACCTGGGAGCTCTGCTGGGGAACAGCACCGATCCCGGAG
TGTTCACAGATCTGGCCTCCGTGGACAACTCTGAGTTTCAGCAGCTGCTG
AATCAGGGCGTGTCCATGTCTCATAGTACAGCCGAACCAATGCTGATGGA
GTACCCCGAAGCCATTACCCGGCTGGTGACCGGCAGCCAGCGGCCCCCCG
ACCCCGCTCCAACTCCCCTGGGAACCAGCGGCCTGCCTAATGGGCTGTCC
GGAGATGAAGACTTCTCAAGCATCGCTGATATGGACTTTAGTGCCCTGCT
GTCACAGATTTCCTCTAGTGGGCAGGGCGGGGAGGCTCCGGTGGTGGGG
GCAGCGGAGGGGGGGCAGCGACTCCGTGGAAATCTCCGGCGTGGAAGAT
CGGTTCAACGCCTCCCTGGGCACATACCACGATCTGCTGAAAATTATCAA
GGACAAGGACTTCCTGGACAATGAGGAAAACGAGGACATTCTGGAAGATA
TCGTGCTGACCCTGACACTGTTTGAGGACAGAGAGATGATCGAGGAACGG
CTGAAAACCTATGCCCACCTGTTCGACGACAAAGTGATGAAGCAGCTGAA
GCGGCGAGATACACCGGCTGGGGCAGGCTGAGCCGGAAGCTGATCAACG
GCATCCGGGACAAGCAGTCCGGCAAGACAATCCTGGATTTCCTGAAGTCC
GACGGCTTCGCCAACAGAAACTTCATGCAGCTGATCCACGACGACAGCCT
GACCTTTAAAGAGGACATCCAGAAAGCCCAGGTGTCCGGCCAGGGCGATA
GCCTGCACGAGCACATTGCCAATCTGGCCGGCAGCCCCGCCATTAAGAAG
GGCATCCTGCAGACAGTGAAGGTGGTGGACGAGCTCGTGAAAGTGATGGG
CCGGCACAAGCCCGAGAACATCGTGATCGAAATGGCCAGAGAGAACCAGA
CCACCCAGAAGGGACAGAAGAACAGCCGCGAGAGAATGAAGCGGATCGAA
GAGGGCATCAAAGAGCTGGGCAGCCAGATCCTGAAAGAACACCCCGTGGA
AAACACCCAGCTGCAGAACGAGAAGCTGTACCTGTACTACCTGCAGAATG
GGCGGGATATGTACGTGGACCAGGAACTGGACATCAACCGGCTGTCCGAC
TACGATGTGGACgcTATCGTGCCTCAGAGCTTTCTGAAGGACGACTCCAT
CGACAACAAGGTGCTGACCAGAAGCGACAAGAACCGGGGCAAGAGCGACA
ACGTGCCCTCCGAAGAGGTCGTGAAGAAGATGAAGAACTACTGGCGGCAG
CTGCTGAACGCCAAGCTGATTACCCAGAGAAAGTTCGACAATCTGACCAA
GGCCGAGAGAGGCGGCCTGAGCGAACTGGATAAGGCCGGCTTCATCAAGA
GACAGCTGGTGGAAACCCGGCAGATCACAAAGCACGTGGCACAGATCCTG
GACTCCCGGATGAACACTAAGTACGACGAGAATGACAAGCTGATCCGGGA
AGTGAAAGTGATCACCCTGAAGTCCAAGCTGGTGTCCGATTTCCGGAAGG
ATTTCCAGTTTTACAAAGTGCGCGAGATCAACAACTACCACCACGCCCAC
GACGCCTACCTGAACGCCGTCGTGGGAACCGCCCTGATCAAAAAGTACCC
TAAGCTGGAAAGCGAGTTCGTGTACGGCGACTACAAGGTGTACGACGTGC
GGAAGATGATCGCCAAGAGCGAGCAGGAAATCGGCAAGGCTACCGCCAAG
TACTTCTTCTACAGCAACATCATGAACTTTTTCAAGACCGAGATTACCCT
GGCCAACGGCGAGATCCGGAAGCGGCCTCTGATCGAGACAAACGGCGAAA
CCGGGGAGATCGTGTGGGATAAGGGCCGGGATTTTGCCACCGTGCGGAAA
GTGCTGAGCATGCCCCAAGTGAATATCGTGAAAAAGACCGAGGTGCAGAC
AGGCGGCTTCAGCAAAGAGTCTATCCTGCCCAAGAGGAACAGCGATAAGC
```

```
TGATCGCCAGAAAGAAGGACTGGGACCCTAAGAAGTACGGCGGCTTCGAC
AGCCCCACCGTGGCCTATTCTGTGCTGGTGGTGGCCAAAGTGGAAAAGGG
CAAGTCCAAGAAACTGAAGAGTGTGAAAGAGCTGCTGGGGATCACCATCA
TGGAAAGAAGCAGCTTCGAGAAGAATCCCATCGACTTTCTGGAAGCCAAG
GGCTACAAAGAAGTGAAAAAGGACCTGATCATCAAGCTGCCTAAGTACTC
CCTGTTCGAGCTGGAAAACGGCCGGAAGAGAATGCTGGCCTCTGCCGGCG
AACTGCAGAAGGGAAACGAACTGGCCCTGCCCTCCAAATATGTGAACTTC
CTGTACCTGGCCAGCCACTATGAGAAGCTGAAGGGCTCCCCCGAGGATAA
TGAGCAGAAACAGCTGTTTGTGGAACAGCACAAGCACTACCTGGACGAGA
TCATCGAGCAGATCAGCGAGTTCTCCAAGAGAGTGATCCTGGCCGACGCT
AATCTGGACAAAGTGCTGTCCGCCTACAACAAGCACCGGGATAAGCCCAT
CAGAGAGCAGGCCGAGAATATCATCCACCTGTTTACCCTGACCAATCTGG
GAGCCCCTGCCGCCTTCAAGTACTTTGACACCACCATCGACCGGAAGAGG
TACACCAGCACCAAAGAGGTGCTGGACGCCACCCTGATCCACCAGAGCAT
CACCGGCCTGTACGAGACACGGATCGACCTGTCTCAGCTGGGAGGCGACa
gcgctGGAGGAGGTGGAAGCGGAGGAGGAGGAAGCGGAGGAGGAGGTAGC
ggaccTaagaaaaagaggaaggTggcggccgct
pSAMca061 dCas9(F575-P65, 3XGS) - AA
                                    (SEQ ID NO: 212)
TMDKKYSIGLAIGTNSVGWAVITDEYKVPSKKFKVLGNTDRHSIKKNLIG
ALLFDSGETAEATRLKRTARRRYTRRKNRICYLQEIFSNEMAKVDDSFFH
RLEESFLVEEDKKHERHPIFGNIVDEVAYHEKYPTIYHLRKKLVDSTDKA
DLRLIYLALAHMIKFRGHFLIEGDLNPDNSDVDKLFIQLVQTYNQLFEEN
PINASGVDAKAILSARLSKSRRLENLIAQLPGEKKNGLFGNLIALSLGLT
PNFKSNFDLAEDAKLQLSKDTYDDDLDNLLAQIGDQYADLFLAAKNLSDA
ILLSDILRVNTEITKAPLSASMIKRYDEHHQDLTLLKALVRQQLPEKYKE
IFFDQSKNGYAGYIDGGASQEEFYKFIKPILEKMDGTEELLVKLNREDLL
RKQRTFDNGSIPHQIHLGELHAILRRQEDFYPFLKDNREKIEKILTFRIP
YYVGPLARGNSRFAWMTRKSEETITPWNFEEVVDKGASAQSFIERMTNFD
KNLPNEKVLPKHSLLYEYFTVYNELTKVKYVTEGMRKPAFLSGEQKKAIV
DLLFKTNRKVTVKQLKEDYFKKIECFDSGGGGSGGGGSGGGGSPSGQISNQA
LALAPSSAPVLAQTMVPSSAMVPLAQPPAPAPVLTPGPPQSLSAPVPKST
QAGEGTLSEALLHLQFDADEDLGALLGNSTDPGVFTDLASVDNSEFQQLL
NQGVSMSHSTAEPMLMEYPEAITRLVTGSQRPPDPAPTPLGTSGLPNGLS
GDEDFSSIADMDFSALLSQISSSGQGGGGSGGGGSGGGGSDSVEISGVED
RFNASLGTYHDLLKIIKDKDFLDNEENEDILEDIVLTLTLFEDREMIEER
LKTYAHLFDDKVMKQLKRRRYTGWGRLSRKLINGIRDKQSGKTILDFLKS
DGFANRNFMQLIHDDSLTFKEDIQKAQVSGQGDSLHEHIANLAGSPAIKK
GILQTVKVVDELVKVMGRHKPENIVIEMARENQTTQKGQKNSRERMKRIE
EGIKELGSQILKEHPVENTQLQNEKLYLYYLQNGRDMYVDQELDINRLSD
YDVDAIVPQSFLKDDSIDNKVLTRSDKNRGKSDNVPSEEVVKKMKNYWRQ
```

-continued

LLNAKLITQRKFDNLTKAERGGLSELDKAGFIKRQLVETRQITKHVAQIL

DSRMNTKYDENDKLIREVKVITLKSKLVSDFRKDFQFYKVREINNYHHAH

DAYLNAVVGTALIKKYPKLESEFVYGDYKVYDVRKMIAKSEQEIGKATAK

YFFYSNIMNFFKTEITLANGEIRKRPLIETNGETGEIVWDKGRDFATVRK

VLSMPQVNIVKKTEVQTGGFSKESILPKRNSDKLIARKKDWDPKKYGGFD

SPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNF

LYLASHYEKLKGSPEDNEQKQLFVEQHKHYLDEIIEQISEFSKRVILADA

NLDKVLSAYNKHRDKPIREQAENIIHLFTLTNLGAPAAFKYFDTTIDRKR

YTSTKEVLDATLIHQSITGLYETRIDLSQLGGDSAGGGGSGGGGSGGGGS

GPKKKRKVAAA pSAMca062 dCas9(K1153-vp64, 1XGS) - DNA
(SEQ ID NO: 213)

GACAAGAAGTACAGCATCGGCCTGGCCATCGGCACCAACTCTGTGGGCTG

GGCCGTGATCACCGACGAGTACAAGGTGCCCAGCAAGAAATTCAAGGTGC

TGGGCAACACCGACCGGCACAGCATCAAGAAGAACCTGATCGGAGCCCTG

CTGTTCGACAGCGGCGAAACAGCCGAGGCCACCCGGCTGAAGAGAACCGC

CAGAAGAAGATACACCAGACGGAAGAACCGGATCTGCTATCTGCAAGAGA

TCTTCAGCAACGAGATGGCCAAGGTGGACGACAGCTTCTTCCACAGACTG

GAAGAGTCCTTCCTGGTGGAAGAGGATAAGAAGCACGAGCGGCACCCCAT

CTTCGGCAACATCGTGGACGAGGTGGCCTACCACGAGAAGTACCCCACCA

TCTACCACCTGAGAAAGAAACTGGTGGACAGCACCGACAAGGCCGACCTG

CGGCTGATCTATCTGGCCCTGGCCCACATGATCAAGTTCCGGGGCCACTT

CCTGATCGAGGGCGACCTGAACCCCGACAACAGCGACGTGGACAAGCTGT

TCATCCAGCTGGTGCAGACCTACAACCAGCTGTTCGAGGAAAACCCCATC

AACGCCAGCGGCGTGGACGCCAAGGCCATCCTGTCTGCCAGACTGAGCAA

GAGCAGACGGCTGGAAAATCTGATCGCCCAGCTGCCCGGCGAGAAGAAGA

ATGGCCTGTTCGGCAACCTGATTGCCCTGAGCCTGGGCCTGACCCCCAAC

TTCAAGAGCAACTTCGACCTGGCCGAGGATGCCAAACTGCAGCTGAGCAA

GGACACCTACGACGACGACCTGGACAACCTGCTGGCCCAGATCGGCGACC

AGTACGCCGACCTGTTTCTGGCCGCCAAGAACCTGTCCGACGCCATCCTG

CTGAGCGACATCCTGAGAGTGAACACCGAGATCACCAAGGCCCCCCTGAG

CGCCTCTATGATCAAGAGATACGACGAGCACCACCAGGACCTGACCCTGC

TGAAAGCTCTCGTGCGGCAGCAGCTGCCTGAGAAGTACAAAGAGATTTTC

TTCGACCAGAGCAAGAACGGCTACGCCGGCTACATTGACGGCGGAGCCAG

CCAGGAAGAGTTCTACAAGTTCATCAAGCCCATCCTGGAAAAGATGGACG

GCACCGAGGAACTGCTCGTGAAGCTGAACAGAGAGGACCTGCTGCGGAAG

CAGCGGACCTTCGACAACGGCAGCATCCCCCACCAGATCCACCTGGGAGA

GCTGCACGCCATTCTGCGGCGGCAGGAAGATTTTTACCCATTCCTGAAGG

ACAACCGGGAAAAGATCGAGAAGATCCTGACCTTCCGCATCCCCTACTAC

GTGGGCCCTCTGGCCAGGGGAAACAGCAGATTCGCCTGGATGACCAGAAA

-continued

GAGCGAGGAAACCATCACCCCCTGGAACTTCGAGGAAGTGGTGGACAAGG

GCGCTTCCGCCCAGAGCTTCATCGAGCGGATGACCAACTTCGATAAGAAC

CTGCCCAACGAGAAGGTGCTGCCCAAGCACAGCCTGCTGTACGAGTACTT

CACCGTGTATAACGAGCTGACCAAAGTGAAATACGTGACCGAGGGAATGA

GAAAGCCCGCCTTCCTGAGCGGCGAGCAGAAAAAGGCCATCGTGGACCTG

CTGTTCAAGACCAACCGGAAAGTGACCGTGAAGCAGCTGAAAGAGGACTA

CTTCAAGAAAATCGAGTGCTTCGACTCCGTGGAAATCTCCGGCGTGGAAG

ATCGGTTCAACGCCTCCCTGGGCACATACCACGATCTGCTGAAAATTATC

AAGGACAAGGACTTCCTGGACAATGAGGAAAACGAGGACATTCTGGAAGA

TATCGTGCTGACCCTGACACTGTTTGAGGACAGAGAGATGATCGAGGAAC

GGCTGAAAACCTATGCCCACCTGTTCGACGACAAAGTGATGAAGCAGCTG

AAGCGGCGGAGATACACCGGCTGGGGCAGGCTGAGCCGGAAGCTGATCAA

CGGCATCCGGGACAAGCAGTCCGGCAAGACAATCCTGGATTTCCTGAAGT

CCGACGGCTTCGCCAACAGAAACTTCATGCAGCTGATCCACGACGACAGC

CTGACCTTTAAAGAGGACATCCAGAAAGCCCAGGTGTCCGGCCAGGGCGA

TAGCCTGCACGAGCACATTGCCAATCTGGCCGGCAGCCCCGCCATTAAGA

AGGGCATCCTGCAGACAGTGAAGGTGGTGGACGAGCTCGTGAAAGTGATG

GGCCGGCACAAGCCCGAGAACATCGTGATCGAAATGGCCAGAGAGAACCA

GACCACCCAGAAGGGACAGAAGAACAGCCGCGAGAGAATGAAGCGGATCG

AAGAGGGCATCAAAGAGCTGGGCAGCCAGATCCTGAAAGAACACCCCGTG

GAAAACACCCAGCTGCAGAACGAGAAGCTGTACCTGTACTACCTGCAGAA

TGGGCGGGATATGTACGTGGACCAGGAACTGGACATCAACCGGCTGTCCG

ACTACGATGTGGACcATCGTGCCTCAGAGCTTTCTGAAGGACGACTCC

ATCGACAACAAGGTGCTGACCAGAAGCGACAAGAACCGGGGCAAGAGCGA

CAACGTGCCCTCCGAAGAGGTCGTGAAGAAGATGAAGAACTACTGGCGGC

AGCTGCTGAACGCCAAGCTGATTACCCAGAGAAAGTTCGACAATCTGACC

AAGGCCGAGAGAGGCGGCCTGAGCGAACTGGATAAGGCCGGCTTCATCAA

GAGACAGCTGGTGGAAACCCGGCAGATCACAAAGCACGTGGCACAGATCC

TGGACTCCCGGATGAACACTAAGTACGACGAGAATGACAAGCTGATCCGG

GAAGTGAAAGTGATCACCCTGAAGTCCAAGCTGGTGTCCGATTTCCGGAA

GGATTTCCAGTTTTACAAAGTGCGCGAGATCAACAACTACCACCACGCCC

ACGACGCCTACCTGAACGCCGTCGTGGGAACCGCCCTGATCAAAAAGTAC

CCTAAGCTGGAAAGCGAGTTCGTGTACGGCGACTACAAGGTGTACGACGT

GCGGAAGATGATCGCCAAGAGCGAGCAGGAAATCGGCAAGGCTACCGCCA

AGTACTTCTTCTACAGCAACATCATGAACTTTTTCAAGACCGAGATTACC

CTGGCCAACGGCGAGATCCGGAAGCGGCCTCTGATCGAGACAAACGGCGA

AACCGGGGAGATCGTGTGGGATAAGGGCCGGGATTTTGCCACCGTGCGGA

AAGTGCTGAGCATGCCCCAAGTGAATATCGTGAAAAAGACCGAGGTGCAG

ACAGGCGGCTTCAGCAAAGAGTCTATCCTGCCCAAGAGGAACAGCGATAA

GCTGATCGCCAGAAAGAAGGACTGGGACCCTAAGAAGTACGGCGGCTTCG

ACAGCCCCACCGTGGCCTATTCTGTGCTGGTGGTGGCCAAAGTGGAAAAG

-continued

```
GGCAAGGGAGGGGGAGGCAGCGGACGGGCTGACGCATTGGACGATTTTGA
TCTGGATATGCTGGGAAGTGACGCCCTCGATGATTTTGACCTTGACATGC
TTGGTTCGGATGCCCTTGATGACTTTGACCTCGACATGCTCGGCAGTGAC
GCCCTTGATGATTTCGACCTGGACATGCTGATTAACGGCGGGGGAGGCTC
CTCCAAGAAACTGAAGAGTGTGAAAGAGCTGCTGGGGATCACCATCATGG
AAAGAAGCAGCTTCGAGAAGAATCCCATCGACTTTCTGGAAGCCAAGGGC
TACAAAGAAGTGAAAAAGGACCTGATCATCAAGCTGCCTAAGTACTCCCT
GTTCGAGCTGGAAAACGGCCGGAAGAGAATGCTGGCCTCTGCCGGCGAAC
TGCAGAAGGGAAACGAACTGGCCCTGCCCTCCAAATATGTGAACTTCCTG
TACCTGGCCAGCCACTATGAGAAGCTGAAGGGCTCCCCCGAGGATAATGA
GCAGAAACAGCTGTTTGTGGAACAGCACAAGCACTACCTGGACGAGATCA
TCGAGCAGATCAGCGAGTTCTCCAAGAGAGTGATCCTGGCCGACGCTAAT
CTGGACAAAGTGCTGTCCGCCTACAACAAGCACCGGGATAAGCCCATCAG
AGAGCAGGCCGAGAATATCATCCACCTGTTTACCCTGACCAATCTGGGAG
CCCCTGCCGCCTTCAAGTACTTTGACACCACCATCGACCGGAAGAGGTAC
ACCAGCACCAAAGAGGTGCTGGACGCCACCCTGATCCACCAGAGCATCAC
CGGCCTGTACGAGACACGGATCGACCTGTCTCAGCTGGGAGGCGACagcg
ctGGAGGAGGTGGAAGCGGAGGAGGAGGAAGCGGAGGAGGAGGTAGCgga
cctaagaaaaagaggaaggtggcggccgct
``` pSAMca062 dCas9(K1153-vp64, 1XGS) - AA
(SEQ ID NO: 214)

```
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFDSVEISGVEDRFNASLGTYHDLLKII
KDKDFLDNEENEDILEDIVLTLTLFEDREMIEERLKTYAHLFDDKVMKQL
KRRRYTGWGRLSRKLINGIRDKQSGKTILDFLKSDGFANRNFMQLIHDDS
LTFKEDIQKAQVSGQGDSLHEHIANLAGSPAIKKGILQTVKVVDELVKVM
GRHKPENIVIEMARENQTTQKGQKNSRERMKRIEEGIKELGSQILKEHPV
ENTQLQNEKLYLYYLQNGRDMYVDQELDINRLSDYDVDAIVPQSFLKDDS
IDNKVLTRSDKNRGKSDNVPSEEVVKKMKNYWRQLLNAKLITQRKFDNLT
KAERGGLSELDKAGFIKRQLVETRQITKHVAQILDSRMNTKYDENDKLIR
EVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQ
TGGFSKESILPKRNSDKLIARKKDWDPKKYGGFDSPTVAYSVLVVAKVEK
GKGGGGSGRADALDDFDLDMLGSDALDDFDLDMLGSDALDDFDLDMLGSD
ALDDFDLDMLINGGGGSSKKLKSVKELLGITIMERSSFEKNPIDFLEAKG
YKEVKKDLIIKLPKYSLFELENGRKRMLASAGELQKGNELALPSKYVNFL
YLASHYEKLKGSPEDNEQKQLFVEQHKHYLDEIIEQISEFSKRVILADAN
LDKVLSAYNKHRDKPIREQAENIIHLFTLTNLGAPAAFKYFDTTIDRKRY
TSTKEVLDATLIHQSITGLYETRIDLSQLGGDSAGGGGSGGGGSGGGGSG
PKKKRKVAAA
``` pSAMca063 dCas9(K1153-vp64, 3XGS) - DNA
(SEQ ID NO: 215)

```
GACAAGAAGTACAGCATCGGCCTGGCCATCGGCACCAACTCTGTGGGCTG
GGCCGTGATCACCGACGAGTACAAGGTGCCCAGCAAGAAATTCAAGGTGC
TGGGCAACACCGACCGGCACAGCATCAAGAAGAACCTGATCGGAGCCCTG
CTGTTCGACAGCGGCGAAACAGCCGAGGCCACCCGGCTGAAGAGAACCGC
CAGAAGAAGATACACCAGACGGAAGAACCGGATCTGCTATCTGCAAGAGA
TCTTCAGCAACGAGATGGCCAAGGTGGACGACAGCTTCTTCCACAGACTG
GAAGAGTCCTTCCTGGTGGAAGAGGATAAGAAGCACGAGCGGCACCCCAT
CTTCGGCAACATCGTGGACGAGGTGGCCTACCACGAGAAGTACCCCACCA
TCTACCACCTGAGAAAGAAACTGGTGGACAGCACCGACAAGGCCGACCTG
CGGCTGATCTATCTGGCCCTGGCCCACATGATCAAGTTCCGGGGCCACTT
CCTGATCGAGGGCGACCTGAACCCCGACAACAGCGACGTGGACAAGCTGT
TCATCCAGCTGGTGCAGACCTACAACCAGCTGTTCGAGGAAAACCCCATC
AACGCCAGCGGCGTGGACGCCAAGGCCATCCTGTCTGCCAGACTGAGCAA
GAGCAGACGGCTGGAAAATCTGATCGCCCAGCTGCCCGGCGAGAAGAAGA
ATGGCCTGTTCGGCAACCTGATTGCCCTGAGCCTGGGCCTGACCCCCAAC
TTCAAGAGCAACTTCGACCTGGCCGAGGATGCCAAACTGCAGCTGAGCAA
GGACACCTACGACGACGACCTGGACAACCTGCTGGCCCAGATCGGCGACC
AGTACGCCGACCTGTTTCTGGCCGCCAAGAACCTGTCCGACGCCATCCTG
CTGAGCGACATCCTGAGAGTGAACACCGAGATCACCAAGGCCCCCCTGAG
CGCCTCTATGATCAAGAGATACGACGAGCACCACCAGGACCTGACCCTGC
TGAAAGCTCTCGTGCGGCAGCAGCTGCCTGAGAAGTACAAAGAGATTTTC
TTCGACCAGAGCAAGAACGGCTACGCCGGCTACATTGACGGCGGAGCCAG
CCAGGAAGAGTTCTACAAGTTCATCAAGCCCATCCTGGAAAAGATGGACG
GCACCGAGGAACTGCTCGTGAAGCTGAACAGAGAGGACCTGCTGCGGAAG
CAGCGGACCTTCGACAACGGCAGCATCCCCCACCAGATCCACCTGGGAGA
GCTGCACGCCATTCTGCGGCGGCAGGAAGATTTTTACCCATTCCTGAAGG
ACAACCGGGAAAAGATCGAGAAGATCCTGACCTTCCGCATCCCCTACTAC
GTGGGCCCTCTGGCCAGGGGAAACAGCAGATTCGCCTGGATGACCAGAAA
GAGCGAGGAAACCATCACCCCCTGGAACTTCGAGGAAGTGGTGGACAAGG
GCGCTTCCGCCCAGAGCTTCATCGAGCGGATGACCAACTTCGATAAGAAC
```

-continued

CTGCCCAACGAGAAGGTGCTGCCCAAGCACAGCCTGCTGTACGAGTACTT

CACCGTGTATAACGAGCTGACCAAAGTGAAATACGTGACCGAGGGAATGA

GAAAGCCCGCCTTCCTGAGCGGCGAGCAGAAAAAGGCCATCGTGGACCTG

CTGTTCAAGACCAACCGGAAAGTGACCGTGAAGCAGCTGAAAGAGGACTA

CTTCAAGAAAATCGAGTGCTTCGACTCCGTGGAAATCTCCGGCGTGGAAG

ATCGGTTCAACGCCTCCCTGGGCACATACCACGATCTGCTGAAAATTATC

AAGGACAAGGACTTCCTGGACAATGAGGAAAACGAGGACATTCTGGAAGA

TATCGTGCTGACCCTGACACTGTTTGAGGACAGAGAGATGATCGAGGAAC

GGCTGAAAACCTATGCCCACCTGTTCGACGACAAAGTGATGAAGCAGCTG

AAGCGGCGGAGATACACCGGCTGGGGCAGGCTGAGCCGGAAGCTGATCAA

CGGCATCCGGGACAAGCAGTCCGGCAAGACAATCCTGGATTTCCTGAAGT

CCGACGGCTTCGCCAACAGAAACTTCATGCAGCTGATCCACGACGACAGC

CTGACCTTTAAAGAGGACATCCAGAAAGCCCAGGTGTCCGGCCAGGGCGA

TAGCCTGCACGAGCACATTGCCAATCTGGCCGGCAGCCCCGCCATTAAGA

AGGGCATCCTGCAGACAGTGAAGGTGGTGGACGAGCTCGTGAAAGTGATG

GGCCGGCACAAGCCCGAGAACATCGTGATCGAAATGGCCAGAGAGAACCA

GACCACCCAGAAGGGACAGAAGAACAGCCGCGAGAGAATGAAGCGGATCG

AAGAGGGCATCAAAGAGCTGGGCAGCCAGATCCTGAAAGAACACCCCGTG

GAAAACACCCAGCTGCAGAACGAGAAGCTGTACCTGTACTACCTGCAGAA

TGGGCGGGATATGTACGTGGACCAGGAACTGGACATCAACCGGCTGTCCG

ACTACGATGTGGACgcTATCGTGCCTCAGAGCTTTCTGAAGGACGACTCC

ATCGACAACAAGGTGCTGACCAGAAGCGACAAGAACCGGGGCAAGAGCGA

CAACGTGCCCTCCGAAGAGGTCGTGAAGAAGATGAAGAACTACTGGCGGC

AGCTGCTGAACGCCAAGCTGATTACCCAGAGAAAGTTCGACAATCTGACC

AAGGCCGAGAGAGGCGGCCTGAGCGAACTGGATAAGGCCGGCTTCATCAA

GAGACAGCTGGTGGAAACCCGGCAGATCACAAAGCACGTGGCACAGATCC

TGGACTCCCGGATGAACACTAAGTACGACGAGAATGACAAGCTGATCCGG

GAAGTGAAAGTGATCACCCTGAAGTCCAAGCTGGTGTCCGATTTCCGGAA

GGATTTCCAGTTTTACAAAGTGCGCGAGATCAACAACTACCACCACGCCC

ACGACGCCTACCTGAACGCCGTCGTGGGAACCGCCCTGATCAAAAGTAC

CCTAAGCTGGAAAGCGAGTTCGTGTACGGCGACTACAAGGTGTACGACGT

GCGGAAGATGATCGCCAAGAGCGAGCAGGAAATCGGCAAGGCTACCGCCA

AGTACTTCTTCTACAGCAACATCATGAACTTTTTCAAGACCGAGATTACC

CTGGCCAACGGCGAGATCCGGAAGCGGCCTCTGATCGAGACAAACGGCGA

AACCGGGGAGATCGTGTGGGATAAGGGCCGGGATTTTGCCACCGTGCGGA

AAGTGCTGAGCATGCCCCAAGTGAATATCGTGAAAAAGACCGAGGTGCAG

ACAGGCGGCTTCAGCAAAGAGTCTATCCTGCCCAAGAGGAACAGCGATAA

GCTGATCGCCAGAAAGAAGGACTGGGACCCTAAGAAGTACGGCGGCTTCG

ACAGCCCCACCGTGGCCTATTCTGTGCTGGTGGTGGCCAAAGTGGAAAAG

GGCAAGGGCAAGAAGCCCAAGACCGAGGCAGCGGAGGGGGGGCAG

-continued

CGGACGGGCTGACGCATTGGACGATTTTGATCTGGATATGCTGGGAAGTG

ACGCCCTCGATGATTTTGACCTTGACATGCTTGGTTCGGATGCCCTTGAT

GACTTTGACCTCGACATGCTCGGCAGTGACGCCCTTGATGATTTCGACCT

GGACATGCTGATTAACGGCGGGGGAGGCTCCGGTGGTGGGGGCAGCGGAG

GGGGGGGCAGCTCCAAGAAACTGAAGAGTGTGAAAGAGCTGCTGGGGATC

ACCATCATGGAAAGAAGCAGCTTCGAGAAGAATCCCATCGACTTTCTGGA

AGCCAAGGGCTACAAAGAAGTGAAAAAGGACCTGATCATCAAGCTGCCTA

AGTACTCCCTGTTCGAGCTGGAAAACGGCCGGAAGAGAATGCTGGCCTCT

GCCGGCGAACTGCAGAAGGGAAACGAACTGGCCCTGCCCTCCAAATATGT

GAACTTCCTGTACCTGGCCAGCCACTATGAGAAGCTGAAGGGCTCCCCCG

AGGATAATGAGCAGAAACAGCTGTTTGTGGAACAGCACAAGCACTACCTG

GACGAGATCATCGAGCAGATCAGCGAGTTCTCCAAGAGAGTGATCCTGGC

CGACGCTAATCTGGACAAAGTGCTGTCCGCCTACAACAAGCACCGGGATA

AGCCCATCAGAGAGCAGGCCGAGAATATCATCCACCTGTTTACCCTGACC

AATCTGGGAGCCCCTGCCGCCTTCAAGTACTTTGACACCACCATCGACCG

GAAGAGGTACACCAGCACCAAAGAGGTGCTGGACGCCACCCTGATCCACC

AGAGCATCACCGGCCTGTACGAGACACGGATCGACCTGTCTCAGCTGGGA

GGCGACagcgctGGAGGAGGTGGAAGCGGAGGAGGAGGAAGCGGAGGAGG

AGGTAGCGgacctaagaaaaagaggaaggtggcggccgctgctag pSAMca063 dCas9(K1153-vp64, 3XGS) - AA
(SEQ ID NO: 216)

DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDAIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ
TGGFSKESILPKRNSDKLIARKKDWDPKKYGGFDSPTVAYSVLVVAKVEK
GKGGGGSGGGGSGGGGSGRADALDDFDLDMLGSDALDDFDLDMLGSDALD
DFDLDMLGSDALDDFDLDMLINGGGGSGGGGSGGGGSSKKLKSVKELLGI
TIMERSSFEKNPIDFLEAKGYKEVKKDLIIKLPKYSLFELENGRKRMLAS
AGELQKGNELALPSKYVNFLYLASHYEKLKGSPEDNEQKQLFVEQHKHYL
DEIIEQISEFSKRVILADANLDKVLSAYNKHRDKPIREQAENIIHLFTLT
NLGAPAAFKYFDTTIDRKRYTSTKEVLDATLIHQSITGLYETRIDLSQLG
GDSAGGGSGGGGSGGGGSGPKKKRKVAAAA pSAMca064 dCas9(K1153-P65, 1XGS) - DNA
(SEQ ID NO: 217)
GACAAGAAGTACAGCATCGGCCTGGCCATCGGCACCAACTCTGTGGGCTG
GGCCGTGATCACCGACGAGTACAAGGTGCCCAGCAAGAAATTCAAGGTGC
TGGGCAACACCGACCGGCACAGCATCAAGAAGAACCTGATCGGAGCCCTG
CTGTTCGACAGCGGCGAAACAGCCGAGGCCACCCGGCTGAAGAGAACCGC
CAGAAGAAGATACACCAGACGGAAGAACCGGATCTGCTATCTGCAAGAGA
TCTTCAGCAACGAGATGGCCAAGGTGGACGACAGCTTCTTCCACAGACTG
GAAGAGTCCTTCCTGGTGGAAGAGGATAAGAAGCACGAGCGGCACCCCAT
CTTCGGCAACATCGTGGACGAGGTGGCCTACCACGAGAAGTACCCCACCA
TCTACCACCTGAGAAAGAAACTGGTGGACAGCACCGACAAGGCCGACCTG
CGGCTGATCTATCTGGCCCTGGCCCACATGATCAAGTTCCGGGGCCACTT
CCTGATCGAGGGCGACCTGAACCCCGACAACAGCGACGTGGACAAGCTGT
TCATCCAGCTGGTGCAGACCTACAACCAGCTGTTCGAGGAAAACCCCATC
AACGCCAGCGGCGTGGACGCCAAGGCCATCCTGTCTGCCAGACTGAGCAA
GAGCAGACGGCTGGAAAATCTGATCGCCCAGCTGCCCGGCGAGAAGAAGA
ATGGCCTGTTCGGCAACCTGATTGCCCTGAGCCTGGGCCTGACCCCCAAC
TTCAAGAGCAACTTCGACCTGGCCGAGGATGCCAAACTGCAGCTGAGCAA
GGACACCTACGACGACGACCTGGACAACCTGCTGGCCCAGATCGGCGACC
AGTACGCCGACCTGTTTCTGGCCGCCAAGAACCTGTCCGACGCCATCCTG
CTGAGCGACATCCTGAGAGTGAACACCGAGATCACCAAGGCCCCCCTGAG
CGCCTCTATGATCAAGAGATACGACGAGCACCACCAGGACCTGACCCTGC
TGAAAGCTCTCGTGCGGCAGCAGCTGCCTGAGAAGTACAAAGAGATTTTC
TTCGACCAGAGCAAGAACGGCTACGCCGGCTACATTGACGGCGGAGCCAG
CCAGGAAGAGTTCTACAAGTTCATCAAGCCCATCCTGGAAAAGATGGACG
GCACCGAGGAACTGCTCGTGAAGCTGAACAGAGAGGACCTGCTGCGGAAG
CAGCGGACCTTCGACAACGGCAGCATCCCCCACCAGATCCACCTGGGAGA
GCTGCACGCCATTCTGCGGCGGCAGGAAGATTTTTACCCATTCCTGAAGG
ACAACCGGGAAAAGATCGAGAAGATCCTGACCTTCCGCATCCCCTACTAC
GTGGGCCCTCTGGCCAGGGGAAACAGCAGATTCGCCTGGATGACCAGAAA
GAGCGAGGAAACCATCACCCCCTGGAACTTCGAGGAAGTGGTGGACAAGG
GCGCTTCCGCCCAGAGCTTCATCGAGCGGATGACCAACTTCGATAAGAAC

CTGCCCAACGAGAAGGTGCTGCCCAAGCACAGCCTGCTGTACGAGTACTT
CACCGTGTATAACGAGCTGACCAAAGTGAAATACGTGACCGAGGGAATGA
GAAAGCCCGCCTTCCTGAGCGGCGAGCAGAAAAAGGCCATCGTGGACCTG
CTGTTCAAGACCAACCGGAAAGTGACCGTGAAGCAGCTGAAAGAGGACTA
CTTCAAGAAAATCGAGTGCTTCGACTCCGTGGAAATCTCCGGCGTGGAAG
ATCGGTTCAACGCCTCCCTGGGCACATACCACGATCTGCTGAAAATTATC
AAGGACAAGGACTTCCTGGACAATGAGGAAAACGAGGACATTCTGGAAGA
TATCGTGCTGACCCTGACACTGTTTGAGGACAGAGAGATGATCGAGGAAC
GGCTGAAAACCTATGCCCACCTGTTCGACGACAAAGTGATGAAGCAGCTG
AAGCGGCGGAGATACACCGGCTGGGGCAGGCTGAGCCGGAAGCTGATCAA
CGGCATCCGGGACAAGCAGTCCGGCAAGACAATCCTGGATTTCCTGAAGT
CCGACGGCTTCGCCAACAGAAACTTCATGCAGCTGATCCACGACGACAGC
CTGACCTTTAAAGAGGACATCCAGAAAGCCCAGGTGTCCGGCCAGGGCGA
TAGCCTGCACGAGCACATTGCCAATCTGGCCGGCAGCCCCGCCATTAAGA
AGGGCATCCTGCAGACAGTGAAGGTGGTGGACGAGCTCGTGAAAGTGATG
GGCCGGCACAAGCCCGAGAACATCGTGATCGAAATGGCCAGAGAGAACCA
GACCACCCAGAAGGGACAGAAGAACAGCCGCGAGAGAATGAAGCGGATCG
AAGAGGGCATCAAAGAGCTGGGCAGCCAGATCCTGAAAGAACACCCCGTG
GAAAACACCCAGCTGCAGAACGAGAAGCTGTACCTGTACTACCTGCAGAA
TGGGCGGGATATGTACGTGGACCAGGAACTGGACATCAACCGGCTGTCCG
ACTACGATGTGGACcATATCGTGCCTCAGAGCTTTCTGAAGGACGACTCC
ATCGACAACAAGGTGCTGACCAGAAGCGACAAGAACCGGGGCAAGAGCGA
CAACGTGCCCTCCGAAGAGGTCGTGAAGAAGATGAAGAACTACTGGCGGC
AGCTGCTGAACGCCAAGCTGATTACCCAGAGAAAGTTCGACAATCTGACC
AAGGCCGAGAGAGGCGGCCTGAGCGAACTGGATAAGGCCGGCTTCATCAA
GAGACAGCTGGTGGAAACCCGGCAGATCACAAAGCACGTGGCACAGATCC
TGGACTCCCGGATGAACACTAAGTACGACGAGAATGACAAGCTGATCCGG
GAAGTGAAAGTGATCACCCTGAAGTCCAAGCTGGTGTCCGATTTCCGGAA
GGATTTCCAGTTTTACAAAGTGCGCGAGATCAACAACTACCACCACGCCC
ACGACGCCTACCTGAACGCCGTCGTGGGAACCGCCCTGATCAAAAAGTAC
CCTAAGCTGGAAAGCGAGTTCGTGTACGGCGACTACAAGGTGTACGACGT
GCGGAAGATGATCGCCAAGAGCGAGCAGGAAATCGGCAAGGCTACCGCCA
AGTACTTCTTCTACAGCAACATCATGAACTTTTTCAAGACCGAGATTACC
CTGGCCAACGGCGAGATCCGGAAGCGGCCTCTGATCGAGACAAACGGCGA
AACCGGGGAGATCGTGTGGGATAAGGGCCGGGATTTTGCCACCGTGCGGA
AAGTGCTGAGCATGCCCCAAGTGAATATCGTGAAAAAGACCGAGGTGCAG
ACAGGCGGCTTCAGCAAAGAGTCTATCCTGCCCAAGAGGAACAGCGATAA
GCTGATCGCCAGAAAGAAGGACTGGGACCCTAAGAAGTACGGCGGCTTCG
ACAGCCCCACCGTGGCCTATTCTGTGCTGGTGGCCAAAGTGGAAAAG
GGCAAGGGAGGGGAGGCAGCCCTTCAGGGCAGATCAGCAACCAGGCCCT
GGCTCTGGCCCCTAGCTCCGCTCCAGTGCTGGCCCAGACTATGGTGCCCT

-continued

```
CTAGTGCTATGGTGCCTCTGGCCCAGCCACCTGCTCCAGCCCCTGTGCTG
ACCCCAGGACCACCCCAGTCACTGAGCGCTCCAGTGCCCAAGTCTACACA
GGCCGGCGAGGGGACTCTGAGTGAAGCTCTGCTGCACCTGCAGTTCGACG
CTGATGAGGACCTGGGAGCTCTGCTGGGGAACAGCACCGATCCCGGAGTG
TTCACAGATCTGGCCTCCGTGGACAACTCTGAGTTTCAGCAGCTGCTGAA
TCAGGGCGTGTCCATGTCTCATAGTACAGCCGAACCAATGCTGATGGAGT
ACCCCGAAGCCATTACCCGGCTGGTGACCGGCAGCCAGCGGCCCCCCGAC
CCCGCTCCAACTCCCCTGGGAACCAGCGGCCTGCCTAATGGGCTGTCCGG
AGATGAAGACTTCTCAAGCATCGCTGATATGGACTTTAGTGCCCTGCTGT
CACAGATTTCCTCTAGTGGGCAGGGAGGGGGGGCAGCTCCAAGAAACTG
AAGAGTGTGAAAGAGCTGCTGGGGATCACCATCATGGAAAGAAGCAGCTT
CGAGAAGAATCCCATCGACTTTCTGGAAGCCAAGGGCTACAAAGAAGTGA
AAAAGGACCTGATCATCAAGCTGCCTAAGTACTCCCTGTTCGAGCTGGAA
AACGGCCGGAAGAGAATGCTGGCCTCTGCCGGCGAACTGCAGAAGGGAAA
CGAACTGGCCCTGCCCTCCAAATATGTGAACTTCCTGTACCTGGCCAGCC
ACTATGAGAAGCTGAAGGGCTCCCCCGAGGATAATGAGCAGAAACAGCTG
TTTGTGGAACAGCACAAGCACTACCTGGACGAGATCATCGAGCAGATCAG
CGAGTTCTCCAAGAGAGTGATCCTGGCCGACGCTAATCTGGACAAAGTGC
TGTCCGCCTACAACAAGCACCGGGATAAGCCCATCAGAGAGCAGGCCGAG
AATATCATCCACCTGTTTACCCTGACCAATCTGGGAGCCCCTGCCGCCTT
CAAGTACTTTGACACCACCATCGACCGGAAGAGGTACACCAGCACCAAG
AGGTGCTGGACGCCACCCTGATCCACCAGAGCATCACCGGCCTGTACGAG
ACACGGATCGACCTGTCTCAGCTGGGAGGCGACagcgctGGAGGAGGTGG
AAGCGGAGGAGGAGGAAGCGGAGGAGGAGGTAGCGgacctaagaaaaaga
ggaaggtggcggccgct
``` pSAMca064 dCas9(K1153-P65, 1XGS) - AA
(SEQ ID NO: 218)
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFDSVEISGVEDRFNASLGTYHDLLKII
KDKDFLDNEENEDILEDIVLTLTLFEDREMIEERLKTYAHLFDDKVMKQL
KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM
GRHKPENIVIEMARENQTTQKGQKNSRERMKRIEEGIKELGSQILKEHPV
ENTQLQNEKLYLYYLQNGRDMYVDQELDINRLSDYDVDAIVPQSFLKDDS
IDNKVLTRSDKNRGKSDNVPSEEVVKKMKNYWRQLLNAKLITQRKFDNLT
KAERGGLSELDKAGFIKRQLVETRQITKHVAQILDSRMNTKYDENDKLIR
EVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQ
TGGFSKESILPKRNSDKLIARKKDWDPKKYGGFDSPTVAYSVLVVAKVEK
GKGGGGSPSGQISNQALALAPSSAPVLAQTMVPSSAMVPLAQPPAPAPVL
TPGPPQSLSAPVPKSTQAGEGTLSEALLHLQFDADEDLGALLGNSTDPGV
FTDLASVDNSEFQQLLNQGVSMSHSTAEPMLMEYPEAITRLVTGSQRPPD
PAPTPLGTSGLPNGLSGDEDFSSIADMDFSALLSQISSSGQGGGGSSKKL
KSVKELLGITIMERSSFEKNPIDFLEAKGYKEVKKDLIIKLPKYSLFELE
NGRKRMLASAGELQKGNELALPSKYVNFLYLASHYEKLKGSPEDNEQKQL
FVEQHKHYLDEIIEQISEFSKRVILADANLDKVLSAYNKHRDKPIREQAE
NIIHLFTLTNLGAPAAFKYFDTTIDRKRYTSTKEVLDATLIHQSITGLYE
TRIDLSQLGGDSAGGGSGGGGSGGGGSGPKKKRKVAAA pSAMca065 dCas9(K1153-P65, 3XGS) - DNA
(SEQ ID NO: 219)
```
atgGACAAGAAGTACAGCATCGGCCTGGCCATCGGCACCAACTCTGTGGG
CTGGGCCGTGATCACCGACGAGTACAAGGTGCCCAGCAAGAAATTCAAGG
TGCTGGGCAACACCGACCGGCACAGCATCAAGAAGAACCTGATCGGAGCC
CTGCTGTTCGACAGCGGCGAAACAGCCGAGGCCACCCGGCTGAAGAGAAC
CGCCAGAAGAAGATACACCAGACGGAAGAACCGGATCTGCTATCTGCAAG
AGATCTTCAGCAACGAGATGGCCAAGGTGGACGACAGCTTCTTCCACAGA
CTGGAAGAGTCCTTCCTGGTGGAAGAGGATAAGAAGCACGAGCGGCACCC
CATCTTCGGCAACATCGTGGACGAGGTGGCCTACCACGAGAAGTACCCCA
CCATCTACCACCTGAGAAAGAAACTGGTGGACAGCACCGACAAGGCCGAC
CTGCGGCTGATCTATCTGGCCCTGGCCCACATGATCAAGTTCCGGGGCCA
CTTCCTGATCGAGGGCGACCTGAACCCCGACAACAGCGACGTGGACAAGC
TGTTCATCCAGCTGGTGCAGACCTACAACCAGCTGTTCGAGGAAAACCCC
ATCAACGCCAGCGGCGTGGACGCCAAGGCCATCCTGTCTGCCAGACTGAG
CAAGAGCAGACGGCTGGAAAATCTGATCGCCCAGCTGCCCGGCGAGAAGA
AGAATGGCCTGTTCGGCAACCTGATTGCCCTGAGCCTGGGCCTGACCCCC
AACTTCAAGAGCAACTTCGACCTGGCCGAGGATGCCAAACTGCAGCTGAG
CAAGGACACCTACGACGACGACCTGGACAACCTGCTGGCCCAGATCGGCG
ACCAGTACGCCGACCTGTTTCTGGCCGCCAAGAACCTGTCCGACGCCATC
CTGCTGAGCGACATCCTGAGAGTGAACACCGAGATCACCAAGGCCCCCCT
GAGCGCCTCTATGATCAAGAGATACGACGAGCACCACCAGGACCTGACCC
TGCTGAAAGCTCTCGTGCGGCAGCAGCTGCCTGAGAAGTACAAAGAGATT
TTCTTCGACCAGAGCAAGAACGGCTACGCCGGCTACATTGACGGCGGAGC -continued CAGCCAGGAAGAGTTCTACAAGTTCATCAAGCCCATCCTGGAAAAGATGG
ACGGCACCGAGGAACTGCTCGTGAAGCTGAACAGAGAGGACCTGCTGCGG
AAGCAGCGGACCTTCGACAACGGCAGCATCCCCCACCAGATCCACCTGGG
AGAGCTGCACGCCATTCTGCGGCGGCAGGAAGATTTTTACCCATTCCTGA
AGGACAACCGGGAAAAGATCGAGAAGATCCTGACCTTCCGCATCCCCTAC
TACGTGGGCCCTCTGGCCAGGGGAAACAGCAGATTCGCCTGGATGACCAG
AAAGAGCGAGGAAACCATCACCCCCTGGAACTTCGAGGAAGTGGTGGACA
AGGGCGCTTCCGCCCAGAGCTTCATCGAGCGGATGACCAACTTCGATAAG
AACCTGCCCAACGAGAAGGTGCTGCCCAAGCACAGCCTGCTGTACGAGTA
CTTCACCGTGTATAACGAGCTGACCAAAGTGAAATACGTGACCGAGGGAA
TGAGAAAGCCCGCCTTCCTGAGCGGCGAGCAGAAAAAGGCCATCGTGGAC
CTGCTGTTCAAGACCAACCGGAAAGTGACCGTGAAGCAGCTGAAAGAGGA
CTACTTCAAGAAAATCGAGTGCTTCGACTCCGTGGAAATCTCCGGCGTGG
AAGATCGGTTCAACGCCTCCCTGGGCACATACCACGATCTGCTGAAAATT
ATCAAGGACAAGGACTTCCTGGACAATGAGGAAAACGAGGACATTCTGGA
AGATATCGTGCTGACCCTGACACTGTTTGAGGACAGAGAGATGATCGAGG
AACGGCTGAAAACCTATGCCCACCTGTTCGACGACAAAGTGATGAAGCAG
CTGAAGCGGCGGAGATACACCGGCTGGGGCAGGCTGAGCCGGAAGCTGAT
CAACGGCATCCGGGACAAGCAGTCCGGCAAGACAATCCTGGATTTCCTGA
AGTCCGACGGCTTCGCCAACAGAAACTTCATGCAGCTGATCCACGACGAC
AGCCTGACCTTTAAAGAGGACATCCAGAAAGCCCAGGTGTCCGGCCAGGG
CGATAGCCTGCACGAGCACATTGCCAATCTGGCCGGCAGCCCCGCCATTA
AGAAGGGCATCCTGCAGACAGTGAAGGTGGTGGACGAGCTCGTGAAAGTG
ATGGGCCGGCACAAGCCCGAGAACATCGTGATCGAAATGGCCAGAGAGAA
CCAGACCACCCAGAAGGGACAGAAGAACAGCCGCGAGAGAATGAAGCGGA
TCGAAGAGGGCATCAAAGAGCTGGGCAGCCAGATCCTGAAAGAACACCCC
GTGGAAAACACCCAGCTGCAGAACGAGAAGCTGTACCTGTACTACCTGCA
GAATGGGCGGGATATGTACGTGGACCAGGAACTGGACATCAACCGGCTGT
CCGACTACGATGTGGACgcTATCGTGCCTCAGAGCTTTCTGAAGGACGAC
TCCATCGACAACAAGGTGCTGACCAGAAGCGACAAGAACCGGGGCAAGAG
CGACAACGTGCCCTCCGAAGAGGTCGTGAAGAAGATGAAGAACTACTGGC
GGCAGCTGCTGAACGCCAAGCTGATTACCCAGAGAAAGTTCGACAATCTG
ACCAAGGCCGAGAGAGGCGGCCTGAGCGAACTGGATAAGGCCGGCTTCAT
CAAGAGACAGCTGGTGGAAACCCGGCAGATCACAAAGCACGTGGCACAGA
TCCTGGACTCCCGGATGAACACTAAGTACGACGAGAATGACAAGCTGATC
CGGGAAGTGAAAGTGATCACCCTGAAGTCCAAGCTGGTGTCCGATTTCCG
GAAGGATTTCCAGTTTTACAAAGTGCGCGAGATCAACAACTACCACCACG
CCCACGACGCCTACCTGAACGCCGTCGTGGGAACCGCCCTGATCAAAAAG
TACCCTAAGCTGGAAAGCGAGTTCGTGTACGGCGACTACAAGGTGTACGA
CGTGCGGAAGATGATCGCCAAGAGCGAGCAGGAAATCGGCAAGGCTACCG -continued CCAAGTACTTCTTCTACAGCAACATCATGAACTTTTTCAAGACCGAGATT
ACCCTGGCCAACGGCGAGATCCGGAAGCGGCCTCTGATCGAGACAAACGG
CGAAACCGGGGAGATCGTGTGGGATAAGGGCCGGGATTTTGCCACCGTGC
GGAAAGTGCTGAGCATGCCCCAAGTGAATATCGTGAAAAAGACCGAGGTG
CAGACAGGCGGCTTCAGCAAAGAGTCTATCCTGCCCAAGAGGAACAGCGA
TAAGCTGATCGCCAGAAAGAAGGACTGGGACCCTAAGAAGTACGGCGGCT
TCGACAGCCCCACCGTGGCCTATTCTGTGCTGGTGGTGGCCAAAGTGGAA
AAGGGCAAGGGCGGGGAGGCTCCGGTGGTGGGGGCAGCGGAGGGGGGGG
CAGCCCTTCAGGGCAGATCAGCAACCAGGCCCTGGCTCTGGCCCCTAGCT
CCGCTCCAGTGCTGGCCCAGACTATGGTGCCCTCTAGTGCTATGGTGCCT
CTGGCCCAGCCACCTGCTCCAGCCCCTGTGCTGACCCCAGGACCACCCCA
GTCACTGAGCGCTCCAGTGCCCAGTCTACACAGGCCGGCGAGGGGACTC
TGAGTGAAGCTCTGCTGCACCTGCAGTTCGACGCTGATGAGGACCTGGGA
GCTCTGCTGGGGAACAGCACCGATCCCGGAGTGTTCACAGATCTGGCCTC
CGTGGACAACTCTGAGTTTCAGCAGCTGCTGAATCAGGGCGTGTCCATGT
CTCATAGTACAGCCGAACCAATGCTGATGGAGTACCCCGAAGCCATTACC
CGGCTGGTGACCGGCAGCCAGCGGCCCCCGACCCCGCTCCAACTCCCCT
GGGAACCAGCGGCCTGCCTAATGGGCTGTCCGGAGATGAAGACTTCTCAA
GCATCGCTGATATGGACTTTAGTGCCCTGCTGTCACAGATTTCCTCTAGT
GGGCAGGGCGGGGAGGCTCCGGTGGTGGGGGCAGCGGAGGGGGGGGCAG
CTCCAAGAAACTGAAGAGTGTGAAAGAGCTGCTGGGGATCACCATCATGG
AAAGAAGCAGCTTCGAGAAGAATCCCATCGACTTTCTGGAAGCCAAGGGC
TACAAAGAAGTGAAAAAGGACCTGATCATCAAGCTGCCTAAGTACTCCCT
GTTCGAGCTGGAAAACGGCCGGAAGAGAATGCTGGCCTCTGCCGGCGAAC
TGCAGAAGGGAAACGAACTGGCCCTGCCCTCCAAATATGTGAACTTCCTG
TACCTGGCCAGCCACTATGAGAAGCTGAAGGGCTCCCCCGAGGATAATGA
GCAGAAACAGCTGTTTGTGGAACAGCACAAGCACTACCTGGACGAGATCA
TCGAGCAGATCAGCGAGTTCTCCAAGAGAGTGATCCTGGCCGACGCTAAT
CTGGACAAAGTGCTGTCCGCCTACAACAAGCACCGGGATAAGCCCATCAG
AGAGCAGGCCGAGAATATCATCCACCTGTTTACCCTGACCAATCTGGGAG
CCCCTGCCGCCTTCAAGTACTTTGACACCACCATCGACCGGAAGAGGTAC
ACCAGCACCAAAGAGGTGCTGGACGCCACCCTGATCCACCAGAGCATCAC
CGGCCTGTACGAGACACGGATCGACCTGTCTCAGCTGGGAGGCGACagcg
ctGGAGGAGGTGGAAGCGGAGGAGGAGGAAGCGGAGGAGGAGGTAGCgga
cctaagaaaaagaggaaggtggcggccgct
pSAMca065 dCas9(K1153-P65, 3XGS) - AA
                        (SEQ ID NO: 220)
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP -continued

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDAIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKGGGSGGGGSGGGGSPSGQISNQALALAPSSAPVLAQTMVPSSAMVP

LAQPPAPAPVLTPGPPQSLSAPVPKSTQAGEGTLSEALLHLQFDADEDLG

ALLGNSTDPGVFTDLASVDNSEFQQLLNQGVSMSHSTAEPMLMEYPEAIT

RLVTGSQRPPDPAPTPLGTSGLPNGLSGDEDFSSIADMDFSALLSQISSS

GQGGGGSGGGGSGGGGSSKKLKSVKELLGITIMERSSFEKNPIDFLEAKG

YKEVKKDLIIKLPKYSLFELENGRKRMLASAGELQKGNELALPSKYVNFL

YLASHYEKLKGSPEDNEQKQLFVEQHKHYLDEIIEQISEFSKRVILADAN

LDKVLSAYNKHRDKPIREQAENIIHLFTLTNLGAPAAFKYFDTTIDRKRY

TSTKEVLDATLIHQSITGLYETRIDLSQLGGDSAGGGSGGGGSGGGGSG

PKKKRKVAAA

Example 18: New Catalytically Inactive dCas9 Proteins

In another aspect of the invention, novel dCas9 mutants are created. Catalytically inactive dCas9 are generated by combination of D10A and N863A mutations, rather than D10A and H840A mutations.

The catalytically inactive dCas9 mutant used in the literature and Applicants' previous experiments was generated by mutations D10A and H840A within the wildtype Cas9 protein. From the crystal structure, Applicants made the observation that H840A fails to form a functional DNA-nickase. This result suggests that the H840A mutation has a greater dysfunctional effect on the Cas9 protein that originally hypothesized; the original theory being that H840A would result in loss of a single nucleopytic site, with no other effects. If the H840A mutation is disrupting other functions or conformational properties of the dCas9 protein, it stands to reason that a dCas9-activator fusion might be partially compromised by H840A. Thus, Applicants are interested in finding other mutations within the HNH domain which could knock out HNH nuclease activity, without disrupting other Cas9 functions. The Cas9/RNA/DNA crystal structure manuscript identifies mutation N863A as precisely such a mutation: N863A knocks out Cas9 double stranded nuclease activity, but permits nickase activity, suggesting that the global function of N863A Cas9 is not fully disrupted. In light of this observation, Applicants have synthesized a double knockout D10A N863A Cas9 mutant for use as a dCas9-activator.

Corresponding Constructs

| pSAMca041 | dCas(N863A)-vp64 |
|---|---|

Sequence information for creating catalytically inactive dCas9 by combination of D10A and N863A mutations, rather than D10A and H840A mutations is provided below:

pSAMca041 dCas(N863A)-vp64 - DNA
(SEQ ID NO: 221)

atgGACAAGAAGTACAGCATCGGCCTGGCCATCGGCACCAACTCTGTGGG

CTGGGCCGTGATCACCGACGAGTACAAGGTGCCCAGCAAGAAATTCAAGG

TGCTGGGCAACACCGACCGGCACAGCATCAAGAAGAACCTGATCGGAGCC

CTGCTGTTCGACAGCGGCGAAACAGCCGAGGCCACCCGGCTGAAGAGAAC

CGCCAGAAGAAGATACACCAGACGGAAGAACCGGATCTGCTATCTGCAAG

AGATCTTCAGCAACGAGATGGCCAAGGTGGACGACAGCTTCTTCCACAGA

CTGGAAGAGTCCTTCCTGGTGGAAGAGGATAAGAAGCACGAGCGGCACCC

CATCTTCGGCAACATCGTGGACGAGGTGGCCTACCACGAGAAGTACCCCA

CCATCTACCACCTGAGAAAGAAACTGGTGGACAGCACCGACAAGGCCGAC

CTGCGGCTGATCTATCTGGCCCTGGCCCACATGATCAAGTTCCGGGGCCA

CTTCCTGATCGAGGGCGACCTGAACCCCGACAACAGCGACGTGGACAAGC

TGTTCATCCAGCTGGTGCAGACCTACAACCAGCTGTTCGAGGAAAACCCC

ATCAACGCCAGCGGCGTGGACGCCAAGGCCATCCTGTCTGCCAGACTGAG

CAAGAGCAGACGGCTGGAAAATCTGATCGCCCAGCTGCCCGGCGAGAAGA

AGAATGGCCTGTTCGGCAACCTGATTGCCCTGAGCCTGGGCCTGACCCCC

AACTTCAAGAGCAACTTCGACCTGGCCGAGGATGCCAAACTGCAGCTGAG

CAAGGACACCTACGACGACGACCTGGACAACCTGCTGGCCCAGATCGGCG

ACCAGTACGCCGACCTGTTTCTGGCCGCCAAGAACCTGTCCGACGCCATC

CTGCTGAGCGACATCCTGAGAGTGAACACCGAGATCACCAAGGCCCCCCT

GAGCGCCTCTATGATCAAGAGATACGACGAGCACCACCAGGACCTGACCC

TGCTGAAAGCTCTCGTGCGGCAGCAGCTGCCTGAGAAGTACAAAGAGATT

TTCTTCGACCAGAGCAAGAACGGCTACGCCGGCTACATTGACGGCGGAGC

CAGCCAGGAAGAGTTCTACAAGTTCATCAAGCCCATCCTGGAAAAGATGG

ACGGCACCGAGGAACTGCTCGTGAAGCTGAACAGAGAGGACCTGCTGCGG

AAGCAGCGGACCTTCGACAACGGCAGCATCCCCCACCAGATCCACCTGGG

AGAGCTGCACGCCATTCTGCGGCGGCAGGAAGATTTTTACCCATTCCTGA

AGGACAACCGGGAAAAGATCGAGAAGATCCTGACCTTCCGCATCCCCTAC

-continued

```
TACGTGGGCCCTCTGGCCAGGGGAAACAGCAGATTCGCCTGGATGACCAG
AAAGAGCGAGGAAACCATCACCCCCTGGAACTTCGAGGAAGTGGTGGACA
AGGGCGCTTCCGCCCAGAGCTTCATCGAGCGGATGACCAACTTCGATAAG
AACCTGCCCAACGAGAAGGTGCTGCCCAAGCACAGCCTGCTGTACGAGTA
CTTCACCGTGTATAACGAGCTGACCAAAGTGAAATACGTGACCGAGGGAA
TGAGAAAGCCCGCCTTCCTGAGCGGCGAGCAGAAAAAGGCCATCGTGGAC
CTGCTGTTCAAGACCAACCGGAAAGTGACCGTGAAGCAGCTGAAAGAGGA
CTACTTCAAGAAAATCGAGTGCTTCGACTCCGTGGAAATCTCCGGCGTGG
AAGATCGGTTCAACGCCTCCCTGGGCACATACCACGATCTGCTGAAAATT
ATCAAGGACAAGGACTTCCTGGACAATGAGGAAAACGAGGACATTCTGGA
AGATATCGTGCTGACCCTGACACTGTTTGAGGACAGAGAGATGATCGAGG
AACGGCTGAAAACCTATGCCCACCTGTTCGACGACAAAGTGATGAAGCAG
CTGAAGCGGCGGAGATACACCGGCTGGGGCAGGCTGAGCCGGAAGCTGAT
CAACGGCATCCGGGACAAGCAGTCCGGCAAGACAATCCTGGATTTCCTGA
AGTCCGACGGCTTCGCCAACAGAAACTTCATGCAGCTGATCCACGACGAC
AGCCTGACCTTTAAAGAGGACATCCAGAAAGCCCAGGTGTCCGGCCAGGG
CGATAGCCTGCACGAGCACATTGCCAATCTGGCCGGCAGCCCCGCCATTA
AGAAGGGCATCCTGCAGACAGTGAAGGTGGTGGACGAGCTCGTGAAAGTG
ATGGGCCGGCACAAGCCCGAGAACATCGTGATCGAAATGGCCAGAGAGAA
CCAGACCACCCAGAAGGGACAGAAGAACAGCCGCGAGAGAATGAAGCGGA
TCGAAGAGGGCATCAAAGAGCTGGCAGCCAGATCCTGAAAGAACACCCC
GTGGAAAACACCCAGCTGCAGAACGAGAAGCTGTACCTGTACTACCTGCA
GAATGGGCGGGATATGTACGTGGACCAGGAACTGGACATCAACCGGCTGT
CCGACTACGATGTGGACCACATCGTGCCTCAGAGCTTTCTGAAGGACGAC
TCCATCGACAACAAGGTGCTGACCAGAAGCGACAAGGCCCGGGGCAAGAG
CGACAACGTGCCCTCCGAAGAGGTCGTGAAGAAGATGAAGAACTACTGGC
GGCAGCTGCTGAACGCCAAGCTGATTACCCAGAGAAAGTTCGACAATCTG
ACCAAGGCCGAGAGAGGCGGCCTGAGCGAACTGGATAAGGCCGGCTTCAT
CAAGAGACAGCTGGTGGAAACCCGGCAGATCACAAAGCACGTGGCACAGA
TCCTGGACTCCCGGATGAACACTAAGTACGACGAGAATGACAAGCTGATC
CGGGAAGTGAAAGTGATCACCCTGAAGTCCAAGCTGGTGTCCGATTTCCG
GAAGGATTTCCAGTTTTACAAAGTGCGCGAGATCAACAACTACCACCACG
CCCACGACGCCTACCTGAACGCCGTCGTGGGAACCGCCCTGATCAAAAAG
TACCCTAAGCTGGAAAGCGAGTTCGTGTACGGCGACTACAAGGTGTACGA
CGTGCGGAAGATGATCGCCAAGAGCGAGCAGGAAATCGGCAAGGCTACCG
CCAAGTACTTCTTCTACAGCAACATCATGAACTTTTTCAAGACCGAGATT
ACCCTGGCCAACGGCGAGATCCGGAAGCGGCCTCTGATCGAGACAAACGG
CGAAACCGGGGAGATCGTGTGGGATAAGGGCCGGGATTTTGCCACCGTGC
GGAAAGTGCTGAGCATGCCCCAAGTGAATATCGTGAAAAAGACCGAGGTG
CAGACAGGCGGCTTCAGCAAAGAGTCTATCCTGCCCAAGAGGAACAGCGA
TAAGCTGATCGCCAGAAAGAAGGACTGGGACCCTAAGAAGTACGGCGGCT
TCGACAGCCCCACCGTGGCCTATTCTGTGCTGGTGGTGGCCAAAGTGGAA
AAGGGCAAGTCCAAGAAACTGAAGAGTGTGAAAGAGCTGCTGGGGATCAC
CATCATGGAAAGAAGCAGCTTCGAGAAGAATCCCATCGACTTTCTGGAAG
CCAAGGGCTACAAAGAAGTGAAAAAGGACCTGATCATCAAGCTGCCTAAG
TACTCCCTGTTCGAGCTGGAAAACGGCCGGAAGAGAATGCTGGCCTCTGC
CGGCGAACTGCAGAAGGGAAACGAACTGGCCCTGCCCTCCAAATATGTGA
ACTTCCTGTACCTGGCCAGCCACTATGAGAAGCTGAAGGGCTCCCCCGAG
GATAATGAGCAGAAACAGCTGTTTGTGGAACAGCACAAGCACTACCTGGA
CGAGATCATCGAGCAGATCAGCGAGTTCTCCAAGAGAGTGATCCTGGCCG
ACGCTAATCTGGACAAAGTGCTGTCCGCCTACAACAAGCACCGGGATAAG
CCCATCAGAGAGCAGGCCGAGAATATCATCCACCTGTTTACCCTGACCAA
TCTGGGAGCCCCTGCCGCCTTCAAGTACTTTGACACCACCATCGACCGGA
AGAGGTACACCAGCACCAAAGAGGTGCTGGACGCCACCCTGATCCACCAG
AGCATCACCGGCCTGTACGAGACACGGATCGACCTGTCTCAGCTGGGAGG
CGACagcgctGGAGGAGGTGGAAGCGGAGGAGGAGGAAGCGGAGGAGGAG
GTAGCggacctaagaaaaagaggaaggtggcggccgctggatccGGACGG
GCTGACGCATTGGACGATTTTGATCTGGATATGCTGGGAAGTGACGCCCT
CGATGATTTTGACCTTGACATGCTTGTTCGGATGCCCTTGATGACTTTG
ACCTCGACATGCTCGGCAGTGACGCCCTTGATGATTTCGACCTGGACATG
CTGATTAAC
``` pSAMca041 dCas(N863A)-vp64 - amino acid
(SEQ ID NO: 222)
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKARGKSDNVPSEEVVKKMKNYWRQLLNAKLITQRKFDNL
TKAERGGLSELDKAGFIKRQLVETRQITKHVAQILDSRMNTKYDENDKLI -continued

```
REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGDSAGGGGSGGGGSGGGGSGPKKKRKVAAAGSGR

ADALDDFDLDMLGSDALDDFDLDMLGSDALDDFDLDMLGSDALDDFDLDM

LIN
```

Example 19: MS2 sgRNA Sequence Architecture—New MS2/dCas9/sgRNA Versions

Applicants generated additional 3' MS2 constructs and other MS2 sgRNA modifications to understand the effects of MS2 sgRNA sequence architecture. The experiments performed focused on two further ideas regarding the MS2 sgRNA sequence architecture.

Figure 50:
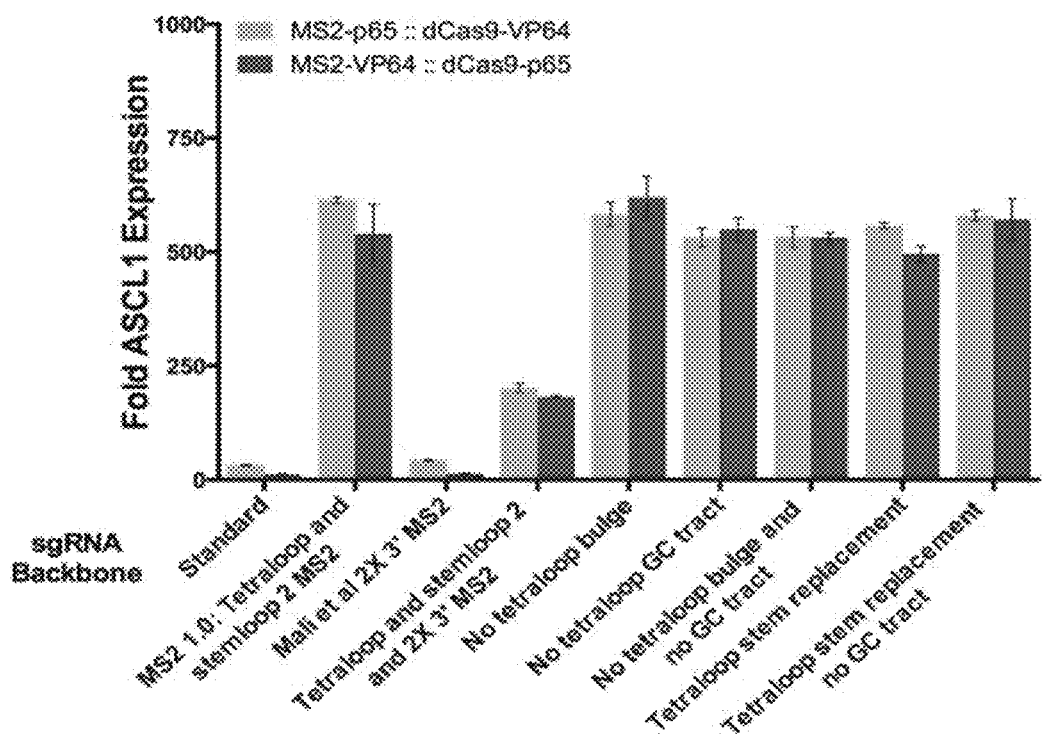
FIG. 50 shows effects of sgRNA modifications on ASCL1 activation. 3' MS2 and modified MS2 1.0 sgRNA architectures were tested for their ability to activate ASCL1.

First, the idea of placing the MS2 binding stems at the 3' end of the sgRNA, rather than inserting these binding sites into the native stemloops of the sgRNA. The use of a pair of 3' MS2 binding sites had previously been described in Mali, Prashant, et al. "CAS9 transcriptional activators for target specificity screening and paired nickases for cooperative genome engineering." *Nature biotechnology* (2013)), though the system was found to perform more poorly than the standard dCas9-VP64/sgRNA activation system. Applicants found that an sgRNA, of their own design, with 2 MS2 binding sites at the 3' end of the sgRNA, as well as MS2 sites at both the tetraloop and stemloop 2, activated both ASCL1 and MYOD1 at a higher level than the 3' MS2 sgRNA from Mali et al. (see FIG. 50) However, Applicants' MS2 1.0, with MS2 sites only at the tetraloop and stemloop 2, was more potent than either of the 3' MS2 sgRNA architectures. (see FIG. 50)

Figure 51:
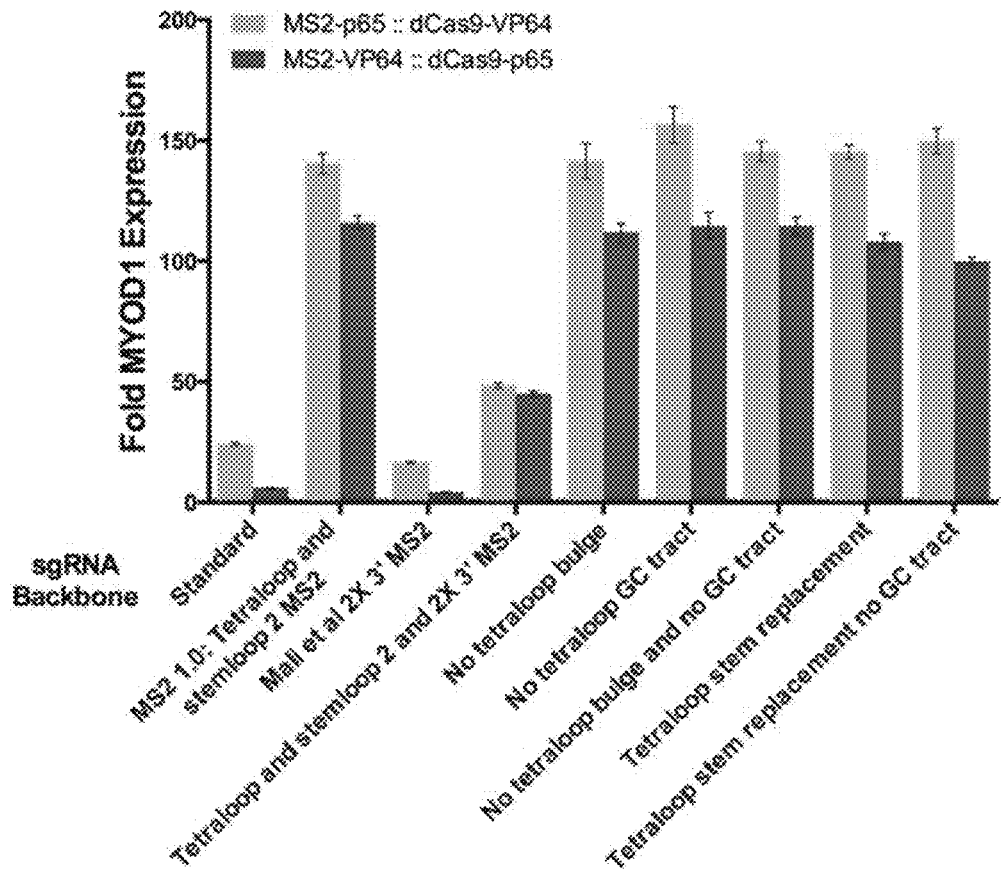
FIG. 51 shows effects of sgRNA modifications MYOD1 activation. 3' MS2 and modified MS2 1.0 sgRNA architectures were tested for their ability to activate ASCL1.
Figure 54:
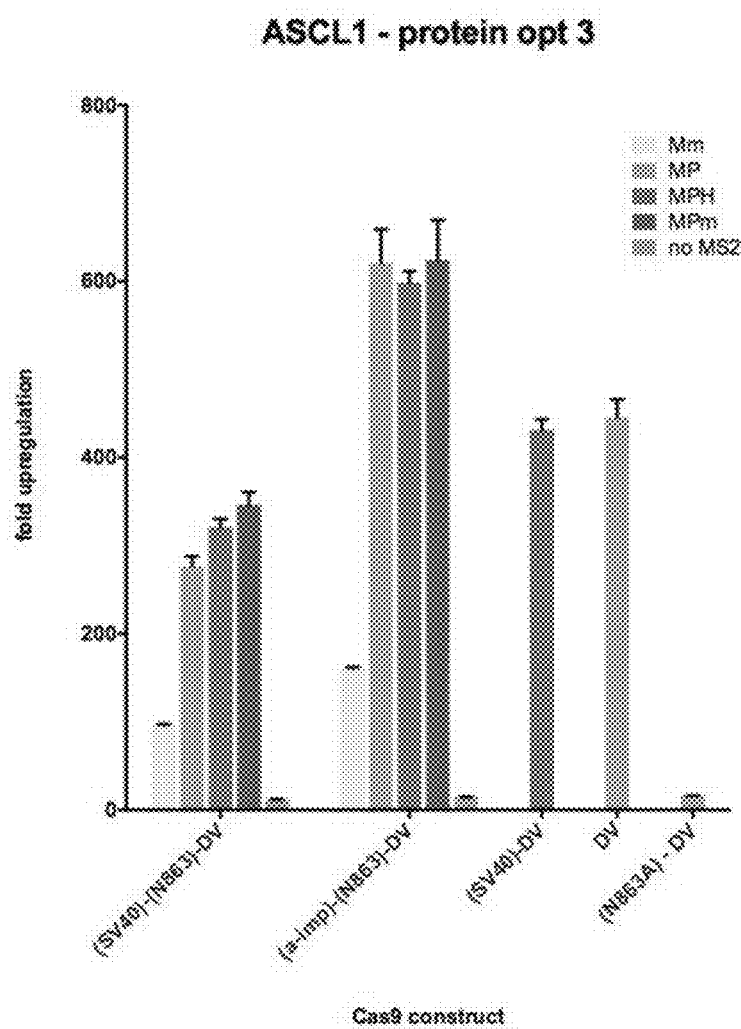
FIG. 54 shows a comparison of different NLS and point mutation dCas-VP64 architectures in combination with MS2 fused to individual or combined activation domains. SV40: SV40 NLS; a-imp: a-importin NLS; DV: dCas-SV40 NLS-VP64; Mm: MS2-ASCL1TAD; MP: MS2-p65; MPH: MS2-p65-HSF1; MPm: MS2-p65-ASCL1TAD. All dCas9 proteins contain D10A mutation and H840A (unless indicated otherwise).

Second, Applicants tested variations within the MS2 1.0 architectures. These modifications included but were not limited to removing the bulge from the MS2 1.0 binding site stem, removing the stabilizing GC tract that had been added to MS2 1.0, shortening the engineered stem by replacing the natural sgRNA stem with the stem of the MS2 binding site, as well as combinations of these approaches. These modifications had little effect on activation level for either ASCL1 or MYOD1, suggesting that the MS2 stemloops are somewhat robust to structural alterations within the MS2/dCas9/sgRNA activation context. In addition to the tetraloop modifications shown in FIG. 51, equivalent modifications were also tested for the MS2 binding site at stemloop 2, with similar results.

dCas9 Protein Modifications (NLS, N863A):

Applicants tested two hypotheses for improvement of the dCas9-activator protein. First, the addition of a second SV40 nuclear localization signal, in addition to the NLS contained in the dCas9 to VP64 linker, was examined as a method of improving dCas9 nuclear localization and transcriptional modulation activity. Placement of the second NLS at the N-terminus of the dCas9 was observed to increase activation in several contexts. The effect was diminished when the second NLS was placed at the C-terminus of the VP64 activation domain. Later experiments (FIGS. 54 and 55) would confirm these effects and suggest a possible improvement by use of an N-terminal alpha-importin NLS, rahter than a second SV40 signal.

Figure 52:
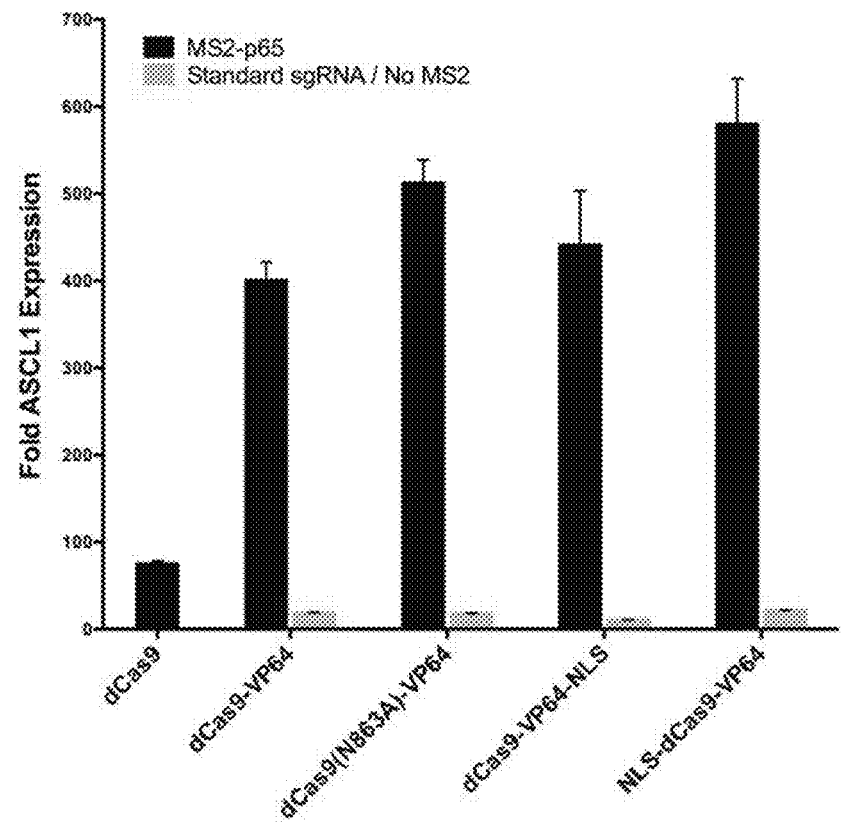
FIG. 52 shows effects of dCas9 NLS and N863A modifications on ASCL1 activation.
Figure 53:
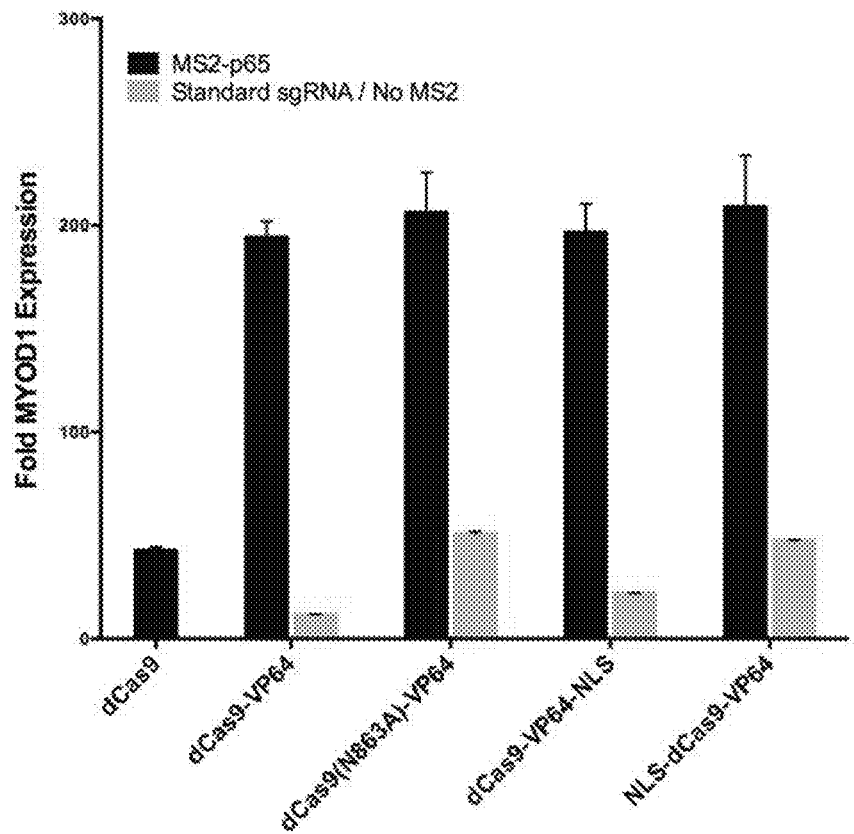
FIG. 53 shows effects of dCas9 NLS and N863A modifications on MYOD1 activation.

Second, Applicants created a version of dCas9 using the N863A mutation, demonstrated in Nishimasu et al., "Crystal structure of Cas9 in complex with guide RNA and target DNA." Cell. 2014 Feb. 27; 156(5):935-49, to be a functional nickase-creating mutation site. This mutation replaces the H840A mutation which was observed to be a suboptimal nickase-creating mutation, suggesting that the H840A mutation, though it can be used with the D10A mutation to abolish nuclease activity, is detrimental in some way to the conformation or functionality of the nickase or dCas9 protein. Applicants observed that the N863A dCas9 acted as a more potent activator protein in certain contexts as shown in FIGS. 52 and 53 for ASCL1 and MYOD1, respectively.

Figure 55:
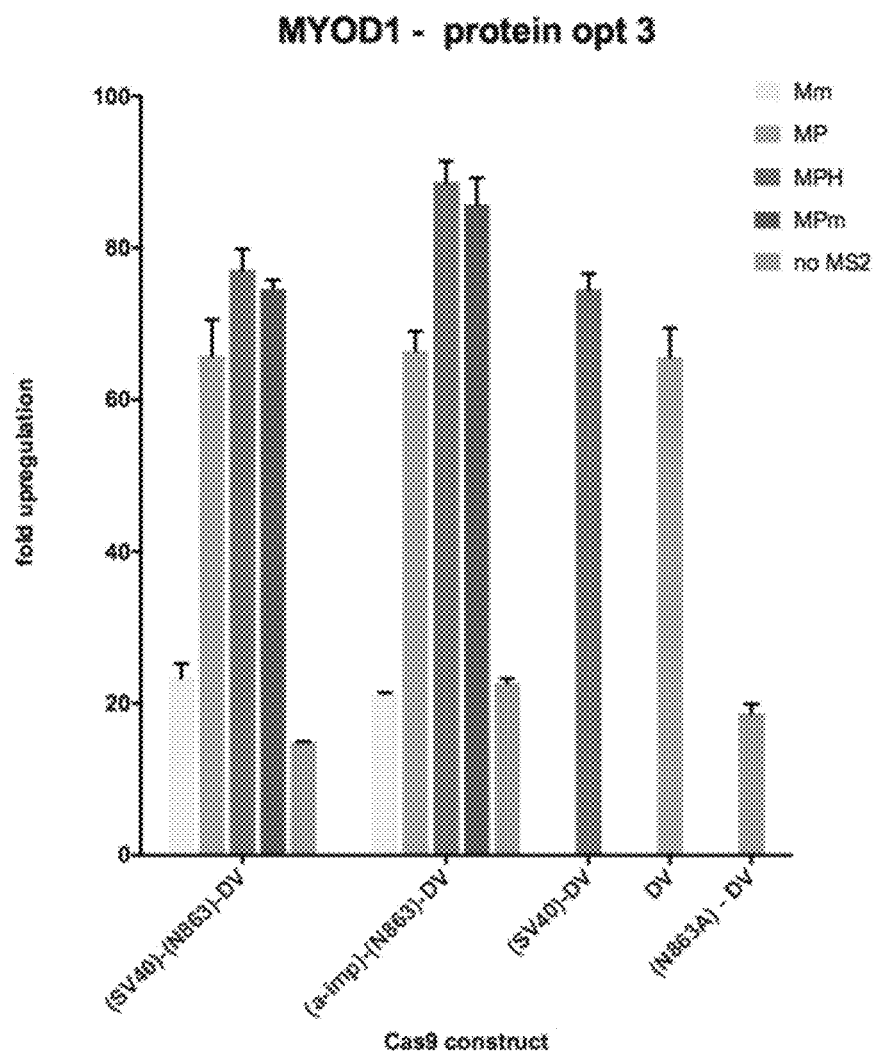
FIG. 55 shows a comparison of different NLS and point mutation dCas-VP64 architectures in combination with MS2 fused to individual or combined activation domains. SV40: SV40 NLS; a-imp: a-importin NLS; DV: dCas-SV40 NLS-VP64; Mm: MS2-MyodTAD; MP: MS2-p65; MPH: MS2-p65-HSF1; MPm: MS2-p65-MyodTAD. All dCas9 proteins contain D10A mutation and H840A (unless indicated otherwise).

New MS2 Activator Fusions Proteins (HSF1, MyoTAD):

Based on Applicants' previous finding that a combination of two different activation domains (P65 and VP64) in the same activator complex (dCas and MS2) yielded greater activation than either domain simply used twice, Applicants wanted to test the potential for synergy between different activation domains further. Applicants constructed fusion proteins of MS2 with two distinct activation domains—either P65 in combination with HSF1 activation domain or P65 in combination with MyoD transactivation domain. Applicants observed the fold upregulation in both ASCL1 and MYOD1 using constructs with different NLS and point mutation dCas-VP64 architectures in combination with MS2 fused to individual or combined activation domains. It was noticed that the addition of an a-importin NLS had a favorable effect on localizing the Cas9 to the nucleus and that the N863A mutation was an advantageous mutation to generate a potent activator (FIGS. 53 and 55). Applicants also determined that a combination of different activator domains had an increased effect. E.g., The construct with a p65-HSF1 fusion was found to be a more potent activator than the construct with p65 alone (FIGS. 56 and 57).

PP7-VP64 Activation:

In addition to the MS2 phage coat protein, which Applicants have employed, a number of phage coat proteins exhibit RNA sequence specific binding. Applicants designed and tested an orthogonal activation system using the RNA binding domain from the PP7 phage. This new system includes the usual (previously described) dCas9-activator protein, a PP7-activator fusion protein, and an sgRNA with PP7 binding sites integrated at the tetraloop and stemloop 2. Applicants observed that the PP7 system functions equally as well as the MS2/dCas9/sgRNA activation system. These results suggest that the sgRNA RNA aptamer approach is generalizable and points to the future possibility of orthogonal modulation modalities using dCas9 and mutually exclusive RNA-binding proteins (such as MS2, PP7, qBeta, GA, and others).

Figure 58:
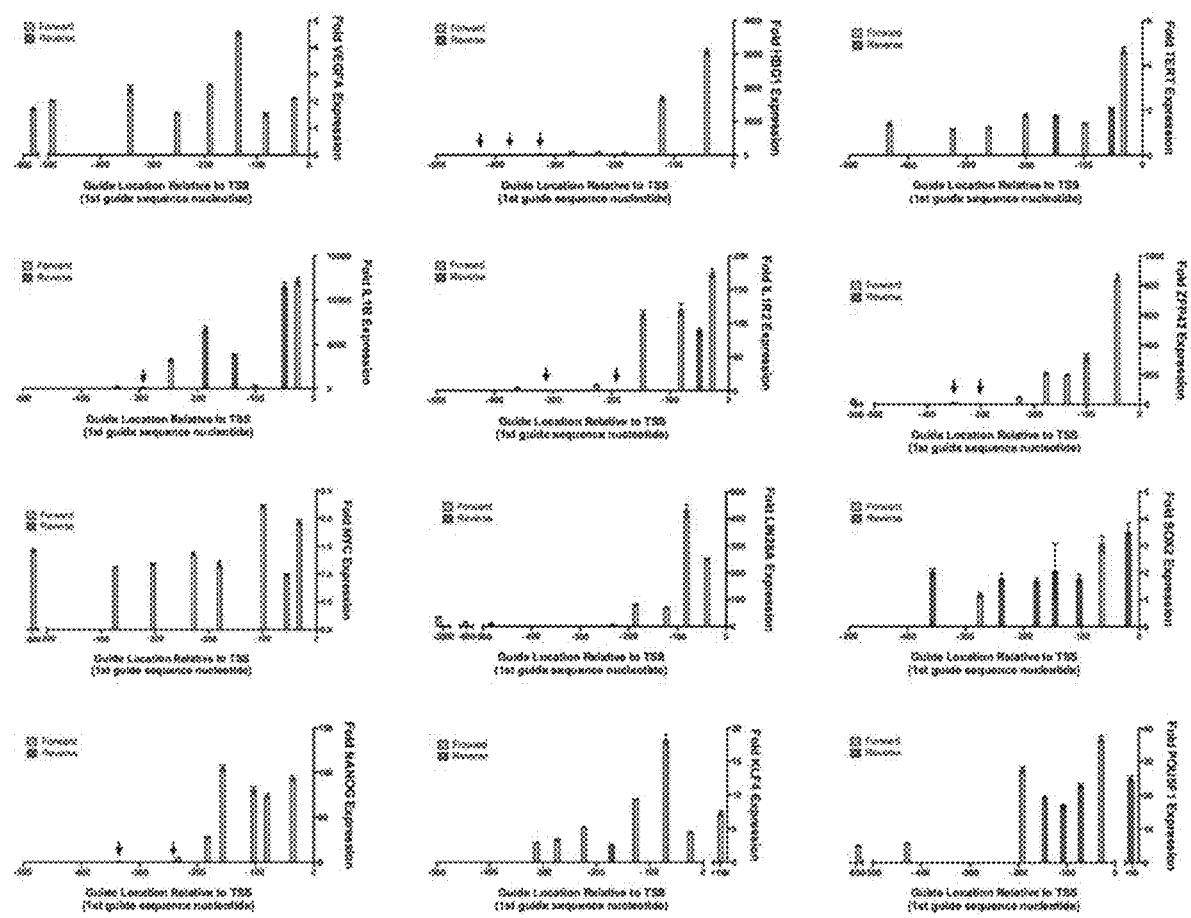
FIG. 58 shows fold expression levels activated by single sgRNA guide sequences for 12 difficult to modulate genes. All activation shown with MS2-p65-HSF1/SV40-dCas9-VP64 system. Guide locations are plotted relative to the TSS of each target.

Target Diversity:

Difficult activation targets and sgRNA TSS proximity: Applicants' early work on CRISPR/Cas9 transcriptional modulation, as well as the published literature has found the majority of targets to be unamenable to activation by single sgRNA guides. Applicants selected 12 gene targets from the literature and Applicants own work which had previously proven difficult or intractable to dCas9 mediated activation. (see FIG. 58) Applicants attempted to activate each of these genes with the MS2-p65-HSF1/SV40-dCas9-VP64/sgRNA system using 1 of 8 guide sequences. Applicants observed significant activation for each of these difficult gene targets, with activation levels for the best guide ranging from 2 fold for MYC to >10,000 for IL1B. 8 of the 12 genes exhibited at least 15 fold expression. (see FIG. 58) For each guide sequence tested, the MS2/dCas9 system performed better than the standard dCas9-VP64 architecture, and no standard system fold expression was greater than 2 for any gene. (see FIG. 58) Additionally, Applicants observed that the success rate of guide sequences typically increased with closer proximity to the transcriptional start site (TSS) of the target gene. In a preferred embodiment of the invention, for particular targets, within 200 bp of the TSS is deemed to be an advantageous window to select guide RNAs. This information could be useful for selection of sgRNA guide sequences for future experiments.

Figure 59:
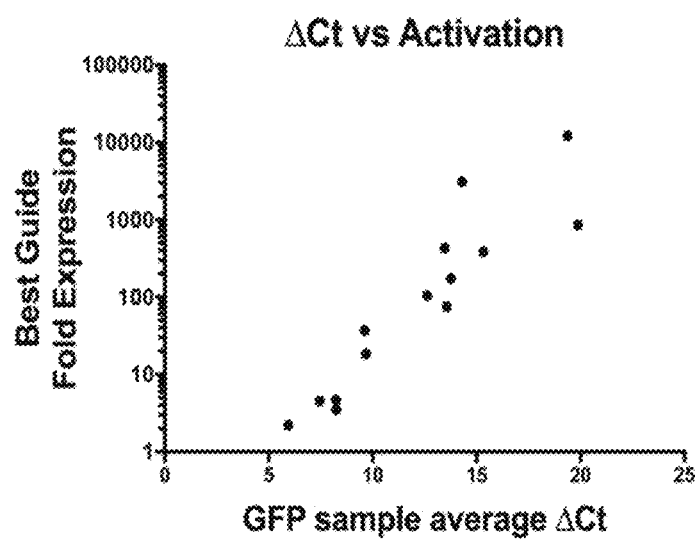
FIG. 59 shows a plot of the fold expression of the best guide sequence against the deltaCt value from qPCR for that gene in control samples for the difficult targets listed above.
Figure 60:
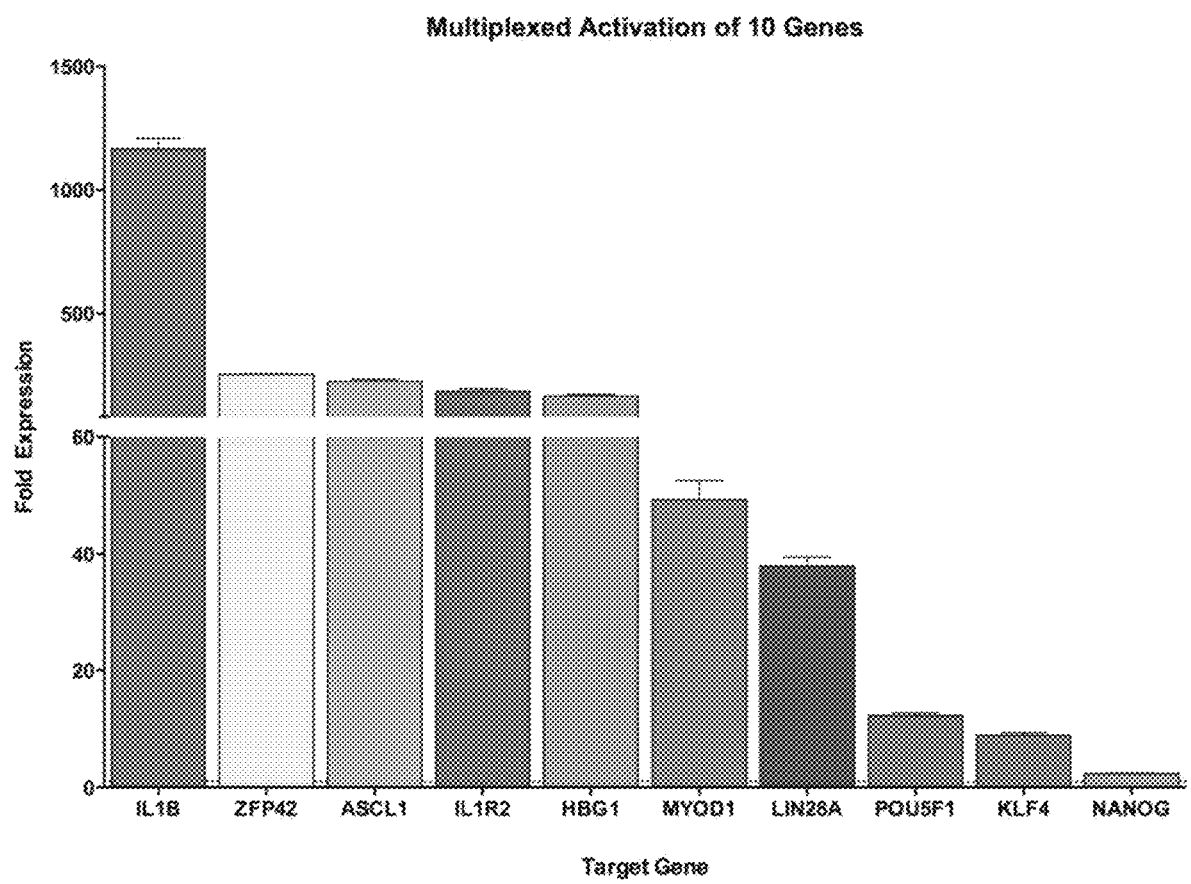
FIG. 60 shows multiplexed activation of ten genes.
Figure 61:
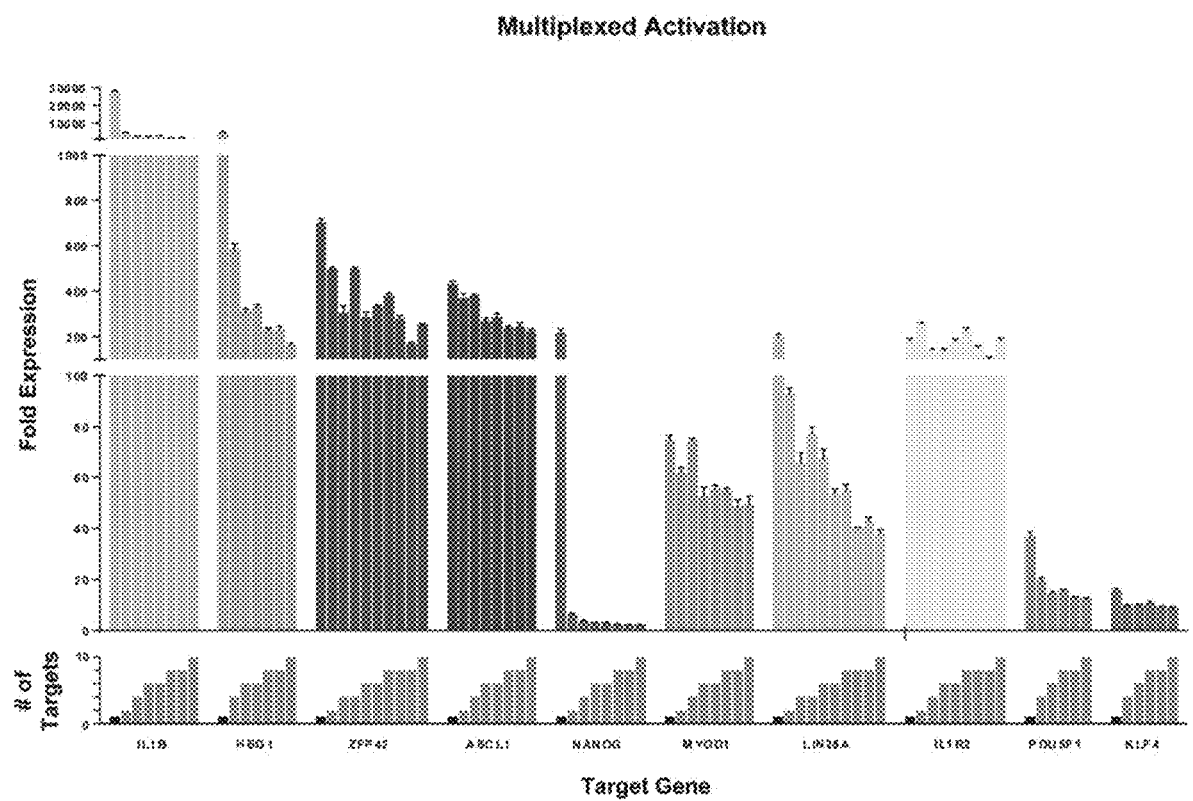
FIG. 61 shows multiplexed activation of target genes.
Figure 62:
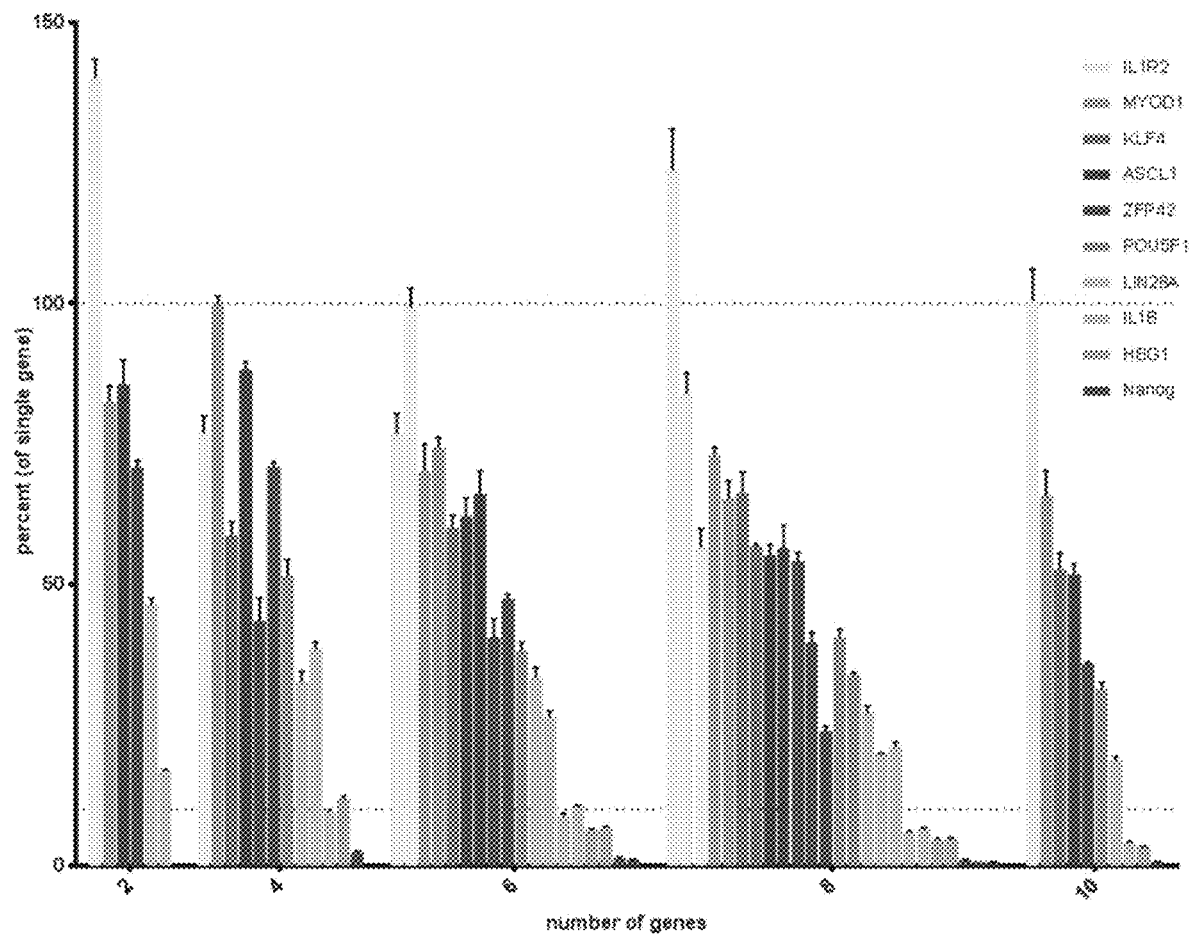
FIG. 62 shows targeting of combinations of 2, 4, 6, 8 or 10 genes simultaneously using the optimal single guide as previously determined. All experiments use NLS-dCAS (D10,H840A)-NLS-VP64 in combination with MS2-NLS-P65-HSF1.
Figure 63:
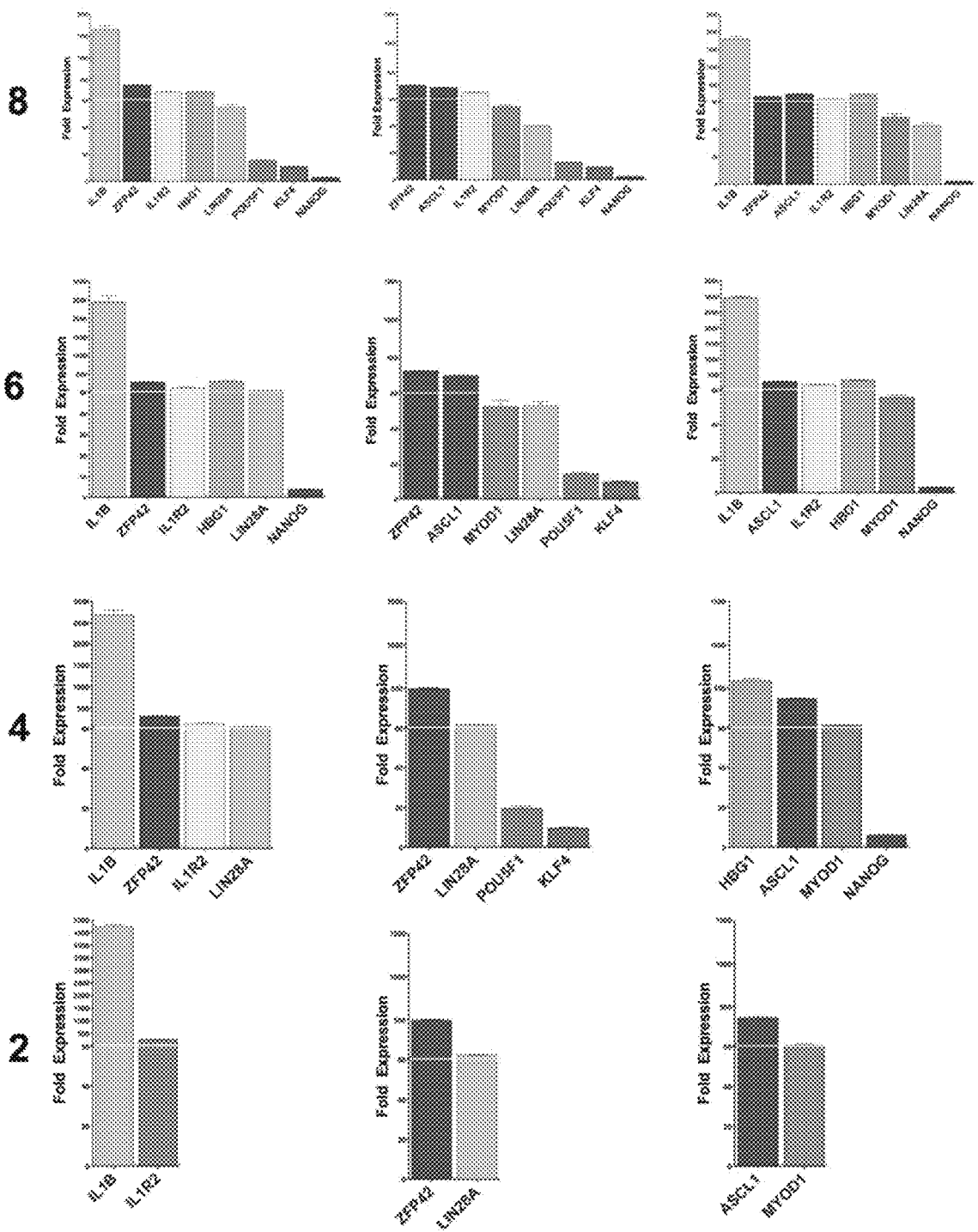
FIG. 63 shows multiplexed activation groups of target genes.

Activation vs. Basal Expression:

An open question in the field of artificial endogenous transcriptional modulation is why are some genes more amenable to activation than others? For the difficult targets listed above, Applicants plotted the fold expression of the best guide sequence against the deltaCt value from qPCR for that gene in control samples. These results suggest a strong inverse correlation between basal gene expression (higher deltaCt corresponds to lower basal expression) and maximal transcriptional activation by the MS2/dCas9/sgRNA system. (see FIG. 59)

Multiplexed Activation:

One important possible advantage of the ability of Applicants' system to provide robust activation with a single guide would be the capacity to easily activate a panel of genes simultaneously (by co-delivery to multiple guides for these genes), which would be intractable if a large number of guides would be required for activation of each gene alone.

In order to test the ability of Applicants' system (NLS-dCAS(D10,H840A)-NLS-VP64 in combination with MS2-NLS-P65-HSF1) to activate multiple genes simultaneously, Applicants co-transfected guides targeting 2, 4, 6, 8 or 10 genes at once. Activation of multiple genes was highly successful, as even for a combination of 10 genes each gene was activated significantly. (see FIGS. 60-63)

Example 20: Structure-Guided Engineering of a CRISPR-Cas9 Complex for Genome-Scale Gene Activation Systematic interrogation of the functional organization of genomes requires the ability to perturb gene expression in a robust and generalizable manner. Structure-guided engineering of the CRISPR-Cas9 complex to mediate efficient transcriptional activation at endogenous genomic loci is described. Engineered Cas9 activators are used to investigate sgRNA-targeting rules for effective transcriptional activation, to demonstrate efficient multiplexed activation of 10 genes simultaneously, and to upregulate long intergenic non-coding RNA (lincRNA) transcripts. A library consisting of 70,290 guides targeting all human RefSeq coding isoforms was synthesized and SAM applied in a melanoma model to screen for genes whose activation confers resistance to the RAF inhibitor PLX-4720, an analog of the therapeutic compound vemurafenib. Expected resistance genes, such as EGFR and G protein-coupled receptor proteins, were enriched in the top hits, as were potentially novel resistance genes, such as members of the integrin family. The signature of the top screening hits was significantly predictive of BRAF inhibitor-resistant states in 29 short-term patient tumor cultures as well as 27 different melanoma cell lines and 113 primary and metastatic patient melanomas, demonstrating the potential of Cas9 activators as a powerful genetics tool.

Achieving genome-scale systematic perturbations within intact biological systems is important for elucidating the function of genes and epigenetic regulation. Genetic perturbations can be broadly classified as either loss-of-function or gain-of-function (GOF) based on their mode of action. Various genome-scale loss-of-function screening methods have been developed, including RNA interference[1,2] and the RNA-guided endonuclease Cas9 from the microbial adaptive immune system CRISPR[3]. Genome-scale GOF screening approaches have largely remained limited to the use of cDNA library overexpression systems. However, it is difficult to capture the complexity of transcript isoform variance using these libraries, and large cDNA sequences are often difficult to clone into viral expression vectors. Moreover, cDNA constructs tend to overdrive gene expression and may not be reflective of physiological protein levels. More generally, the endogenous regulatory contexts of the overexpressed genes cannot be recapitulated. Therefore, methods to enable genome-scale GOF perturbations at endogenous loci remain sought-after.

Programmable DNA binding proteins have emerged as an exciting platform for modulating transcription at endogenous genomic loci[4-13]. Among the established synthetic transcription factor platforms, the CRISPR-associated endonuclease Cas9 is most easily scaled to facilitate genome-scale perturbations[14-16] due to the simplicity of programming and producing the system relative to zinc finger proteins and transcription activator-like effectors (TALEs). Cas9 nuclease can be easily converted into a RNA-guided DNA binding protein (dCas9) by inactivating both of its catalytic domains[17,18]. dCas9 can be fused with transcription activation domains and retargeted to the promoter region of endogenous genes to achieve targeted modulation of gene expression[7,8,10-12]. Although the current generation of dCas9-based transcription effectors are able to achieve activation of some endogenous loci, the magnitude of transcriptional up-regulation achieved by individual single-guide RNAs (sgRNAs) typically ranges from low to ineffective[8,10,12]. Targeting a combination of sgRNAs tiling to a given promoter region can result in more robust transcriptional activation but this requirement presents enormous challenges for scalability, and in particular for establishing pooled, genome-wide GOF screens using dCas9.

In order to improve and expand applications of Cas9, crystallographic studies, elucidating the atomic structure of the Cas9-sgRNA-target DNA tertiary complex[17], were undertaken, enabling rational engineering of Cas9 and sgRNA. This example provides a series of structure-guided engineering steps resulting in a potent transcription activation complex capable of mediating robust up-regulation with a single sgRNA. Using this new activation system, activation of endogenous genes as well as non-coding RNAs is demonstrated, the design rules for effective sgRNA target sites are elucidated, and a genome-wide dCas9-based transcription activation screening system to study targeted therapy resistance in a cellular model of melanoma is established and applied. These results collectively demonstrate the potentially broad applicability of RNA-guided gain-of-function (GOF) screening for functional genomics research.

Structure-Guided Design of a dCas9-Based Transcription Activation Complex

Figure 70A:
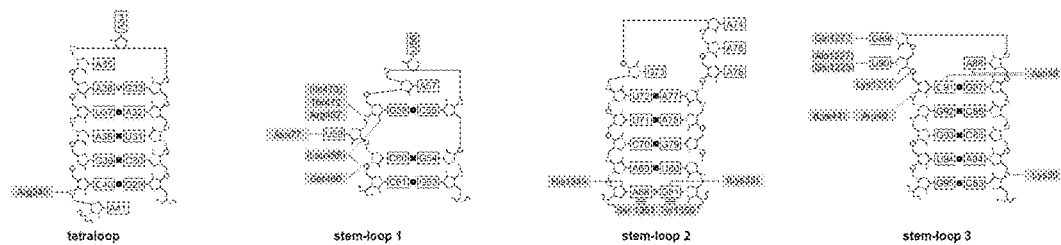
FIG. 70A-E shows structure-guided engineering of Cas9 sgRNA. a, Schematic of the sgRNA stem-loops showing contacts between each stem-loop and Cas9. Contacting amino acid residues are highlighted in yellow. Tetraloop and stem-loop 2 do not have any contacts with Cas9 whereas stem-loops 1 and 3 share extensive contacts with Cas9. b, sgRNA2.0 with MS2 stem-loops inserted into the tetraloop and stem-loop 2. c, Addition of a second NLS or an alternative HNH domain inactivating point mutation in Cas9 improve efficiency of transcription activation for MYOD1. d, dCas9-VP64 activators exhibit improved performance by recruitment of MS2-P65 to the tetraloop and stem-loop 2. Addition of an AU flip or extension in the tetraloop does not increased effectiveness of dCas9-mediated transcription activation. e, Tetraloop and stem-loop 2 are amenable to replacement with MS2 stem-loops. Base changes from the sgRNA2.0 scaffold are shown at the respective positions, with dashes indicating unaltered bases and bases below dashes indicating insertions. Deletions are indicated by absence of dashes at respective positions. All figures are n=3 and mean±SEM.
Figure 70B:
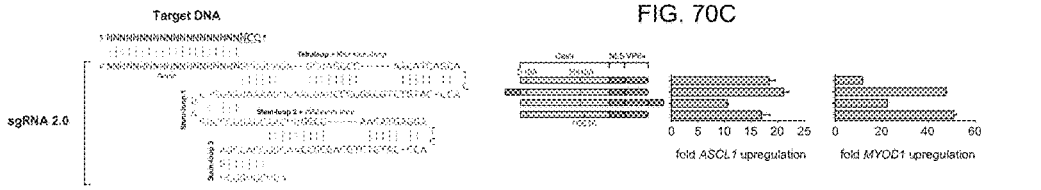

A key step in transforming the Cas9-sgRNA complex into an effective transcriptional activator is finding optimal anchoring positions for the activation domains. An ideal position would be proximally located relative to the target DNA to allow efficient interaction between the transcription machinery and target DNA, as well as permit unobstructed presentation of the transactivating effector to recruit transcription machinery. The crystal structure of the *Streptococcus pyogenes* dCas9 (D10A/H840A) in complex with a single guide RNA (sgRNA) and complementary target DNA revealed a ribonucleoprotein complex in which the sgRNA-target DNA heteroduplex serves as a scaffold for the three-dimensional organization of the Cas9 protein domains. The N- and C-termini of Cas9 are located at the opposite side to the sgRNA-target DNA heteroduplex-binding groove (FIG. 64a), indicating that fusing transactivating peptides at these locations, as reported in previous dCas9-activator designs, may be suboptimal. It was observed that the tetraloop and stem-loop 2 of the sgRNA protrude outside of the Cas9-sgRNA ribonucleoprotein complex, with the distal 4 bp of each stem completely free of interactions with Cas9 amino acid sidechains (FIG. 70a). Both tetraloop and stem-loop 2 are also more proximal to the target DNA than either the N- or C-terminus and could provide better anchoring positions for effectors. Based on these observations and functional data showing that substitutions and deletions in the tetraloop and stem-loop 2 regions of the sgRNA sequence do not affect Cas9 catalytic function[17] (FIG. 64a), it was reasoned that the tetraloop and stem-loop 2 can be extended to incorporate protein-interacting aptamers, facilitating the recruitment of effectors to the Cas9 complex (FIG. 64b).

A minimal hairpin aptamer capable of binding to the bacteriophage coat protein MS2, which is known to be capable of binding MS2 through strong sequence- and structure-specific interactions in mammalian cells[18,19], to incorporate into tetraloop and stem-loop 2 (FIG. 70b) was chosen. Tests were performed to evaluate whether MS2-mediated recruitment of VP64 to the tetraloop and stem-loop 2 could mediate transcriptional up-regulation more efficiently than a dCas9-VP64 fusion alone. Aptamer-mediated recruitment of MS2-VP64 to either tetraloop (sgRNA 1.1) or stem-loop 2 (sgRNA 1.2) mediated 3- and 5-fold higher levels of Neurog2 up-regulation than a dCas9-VP64 fusion (sgRNA 1.0), respectively. Recruitment of VP64 to both positions (sgRNA 2.0) resulted in an additive effect, leading to 12-fold increase over dCas9-VP64 (sgRNA 1.0). Combining sgRNA 2.0 with dCas9-VP64 instead of dCas9 provided an additional 1.3-fold increase in Neurog2 up-regulation.

To confirm that spatial positioning, and not simply the number of activation domains, is the critical factor for effective transcription activation, sgRNA2.0 was compared to a previously described sgRNA bearing two MS2-binding stem-loops at the 3' end (sgRNA+2×MS2)[11]. sgRNA2.0 drove 14- and 8.5-fold higher levels of transcription activation than sgRNA+2×MS2 for ASCL1 and MYOD1, respectively (FIG. 64d).

Effector Domains Act in Synergy to Enhance Transcription Activation

To further improve the potency of Cas9-mediated transcription activation, how transcription activation is achieved in natural contexts was considered. Endogenous transcription factors generally act in synergy with co-factors to stimulate transcription[20]. It was hypothesized that combining VP64 with additional, distinct activation domains could improve activation efficiency through synergy. NF-κB transactivating subunit p65 was chosen, which, while sharing some common co-factors with VP64, recruits a distinct subset of transcription factors and chromatin remodeling complexes. For example, p65 has been shown to recruit Ap-1, ATF/CREB, and Sp1[21], whereas VP64 recruits PC4[22], CBP/p300[23], and the SWI/SNF complex[24].

Figure 70C:
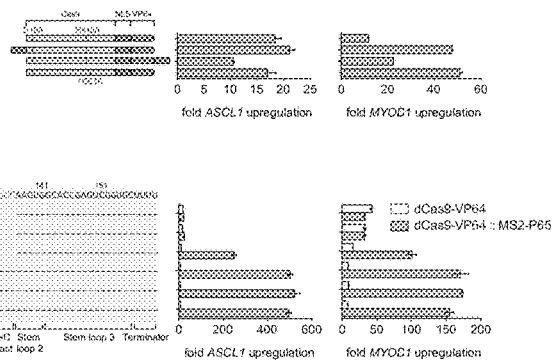
Figure 70D:
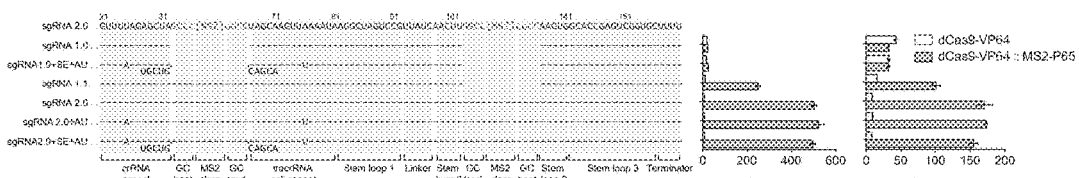
Figure 70E:
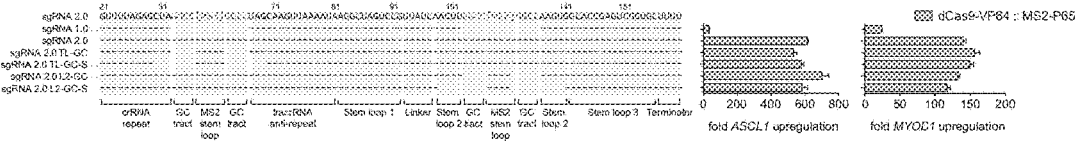

The effector domain fused to dCas9 and MS2 was varied. Hetero-effector pairing of dCas9 and MS2 fusion proteins (e.g. dCas9-VP64 paired with MS2-p65 or dCas9-p65 with MS2-VP64) provided over 2.5-fold higher transcription activation for both ASCL1 and MYOD1 than same-effector pairing (e.g. dCas9-VP64 paired with MS2-VP64 or dCas9-p65 with MS2-p65) (FIG. 64e). This concept of domain synergy was further explored by introducing the activation domain from human heat-shock factor 1 (HSF1) (Marinho et al., Redox Biol 2014) as a third activation domain, and it was demonstrated that an MS2-p65-HSF1 fusion protein further improved transcriptional activation of ASCL1 (12%) and MYOD1 (37%). Additional modifications to the sgRNA as well as Cas9 protein provided only minor improvements (FIG. 70c-e). Based on these results it was concluded that the combination of sgRNA2.0, NLS-dCas9-VP64, and MS2-p65-HSF1 comprises the most effective transcription activation system, and designated it SAM. For simplicity, sgRNA2.0 is referred to as sgRNA in subsequent discussions of this example, unless noted otherwise.

Characterization of SAM Efficacy and Determination of sgRNA Efficiency Rules

To thoroughly evaluate the effectiveness of SAM for activating endogenous gene transcription, 12 genes were chosen that have been found previously to be difficult to activate using dCas9-VP64 and individual sgRNA1.0 guides[8,11,12]. For each gene, 8 sgRNA target sites spread across the proximal promoter between −1000 bp and the +1 transcription start site (TSS) were selected. For 9 out of 12 genes, the maximum level of activation achieved using dCas9-VP64 with any of the 8 sgRNA1.0 guides was less than 2-fold, while the remaining three genes (ZFP42, KLF4 and IL1b) were maximally activated between 2- and 5-fold (FIG. 65a). In contrast, SAM stimulated transcription at least 2-fold for all genes and more than 15-fold for 8 out of 12 genes. Consistently, SAM performed better than sgRNA1.0+dCas9-VP64 for all 96 guides, with a median gain of 105-fold higher expression up-regulation across all 12 genes.

Figure 71A:
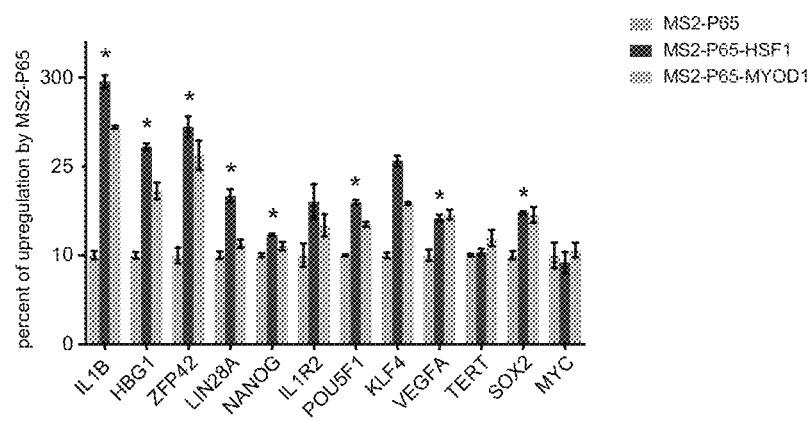
FIG. 71A-C shows SAM mediates efficient activation of a panel of 12 genes with low levels of non-specific activation. a, Comparison of the activation levels of 12 genes with dCas9-VP64 in combination with MS2-P65, MS2-P65-HSF1, or MS2-P65-MYOD1. MS2-P65-HSF1 mediated significantly higher activation than MS2-P65 alone for 9 out of 12 genes. The best guide out of 8 tested for each gene (see FIG. 2a) was used is used in this experiment. Activation levels for each type of MS2-fusion is presented as a percentage relative to the activation achieved using MS2-P65. b, Non-specific background activation by dCas9-VP64 and MS2-p65-HSF1 activator components was determined for all 12 genes. dCas9-VP64 and MS2-p65-HSF1 were co-transfected with non-targeting (scrambled) guides. Cells transfected with GFP were used to measure the baseline expression level for each gene. Only activation of IL1R2 by scrambled guides is significantly different from GFP samples. p<0.05 by Student's t-test. c, The average activation for both scrambled guides shown as % of the on-target activation as shown in a. Activation by scrambled guides measures below 1% of on-target activation for all 12 genes. Error bars indicate SEM. n=3.
Figure 71B:
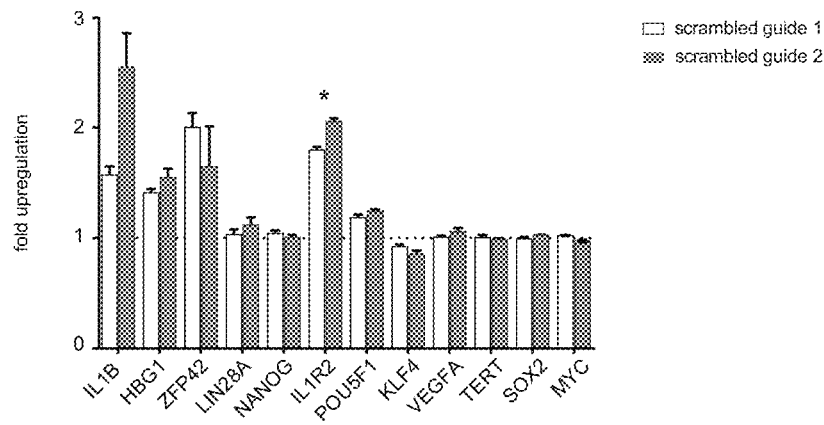
Figure 71C:
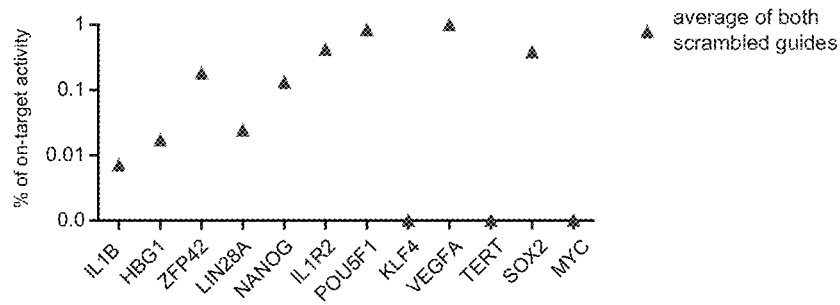

Previous studies have demonstrated that poor activation efficiency of single sgRNA can be overcome by combining dCas9-VP64 with a pool of sgRNAs tiling the proximal promoter region of the target gene[10-12]. Therefore the single sgRNA activation efficiency of SAM was compared with dCas9-VP64 combined with a pool of 8 same-gene targeting sgRNA 1.0 guides. For most genes, SAM with a single sgRNA performed more robustly than dCas9-VP64 with pools of 8 sgRNA1.0 guides (FIG. 65b). On average, SAM with single sgRNAs achieved 15 times more activation than dCas9-VP64 combined with pools of 8 sgRNA 1.0 guides. For all 12 genes, SAM incorporating three distinct activation domains (dCas9-VP64 with either MS2-p65-HSF1 or MS2-p65-MyoD1, whereas MyoD1 is a transactivating peptide derived from the human MYOD1 gene[25]) performed better than SAM incorporating only two distinct activation domains (dCas9-VP64 with MS2-p65) (FIG. 71a). For 9 out of 12 genes, triple-domain SAM achieved between 42% to 196% greater activation than double-domain SAM (p<0.01, Student's t-test with FDR correction). Also, triple-domain SAM with a non-targeting sgRNA generated less than 1% non-specific activation compared to activation by a targeting sgRNA (FIGS. 71b and c).

Next, studies were performed to determine factors that contribute inter- and intragenic variability of activation efficiency by different sgRNAs. For intergene variability, the variation in the activation levels between sgRNAs and target genes was analyzed. Differences in activation levels could stem from how tightly a given locus is regulated and/or from variation in its basal level of transcription. Thus, correlation between basal transcription and the level of transcription activation achieved using SAM was of particular interest. Using the relative transcript level of target genes in control samples, a highly significant correlation between the inverse of basal transcript level and the fold up-regulation achieved using SAM was observed (FIG. 65c; r=0.94, p<0.0001). Whereas highly expressed genes (e.g. MYC, VEGFA, TERT, SOX2) were moderately upregulated, lowly expressed genes (e.g. HBG1, IL1B, ZFP42) were more significantly upregulated by SAM.

For intragenic variability, the activation data was aggregated for all 96 guides and the distance between the guide RNA target site and the TSS was found to be the most significant predictor of activation efficiency (FIG. 65d; r=0.67, p<0.0001). The strongest guides for each gene were always located within −200 bp and +1. A high fraction of guides were efficient in this window—85% of guides within 200 bp upstream of the TSS achieved at least 25% of the maximal activation of a given gene. This simple finding can be used to inform the selection of efficient sgRNAs for gene activation.

Transcriptional Activation of lincRNAs

Figure 66A:
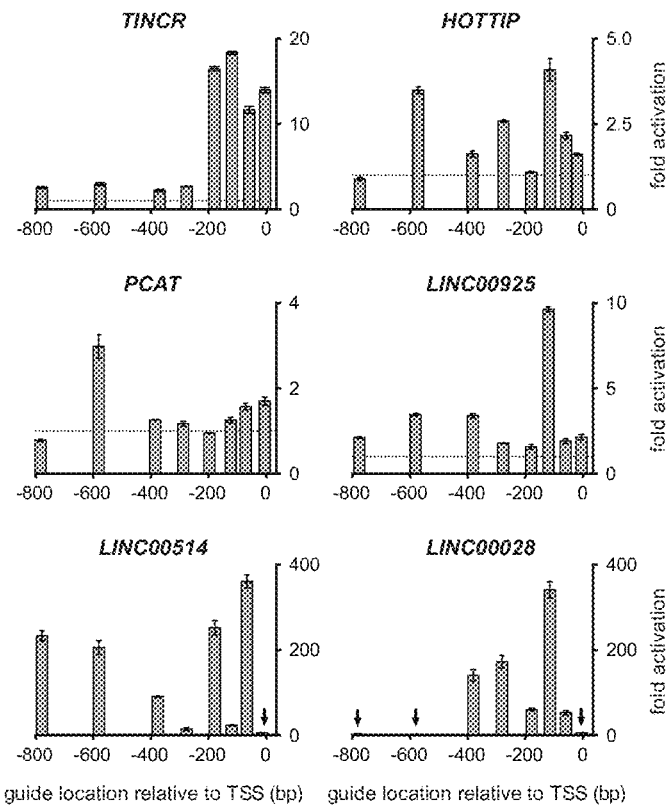
FIG. 66A-B shows SAM activates characterized and uncharacterized lincRNA transcripts. a, Fold activation of 6 lincRNAs plotted against the location of the sgRNA2.0 relative to the TSS. All values are mean+−SEM with n=3. b, Correlation of sgRNA lincRNA-activation efficiency with sgRNA target distance to the TSS. Activation efficiencies of each sgRNA for the same target lincRNA is normalized against the highest-activating sgRNA. In contrast to coding genes, no significant correlation is observed. Blue lines indicate median values, boxes indicate 25th and 75th percentiles.
Figure 66B:
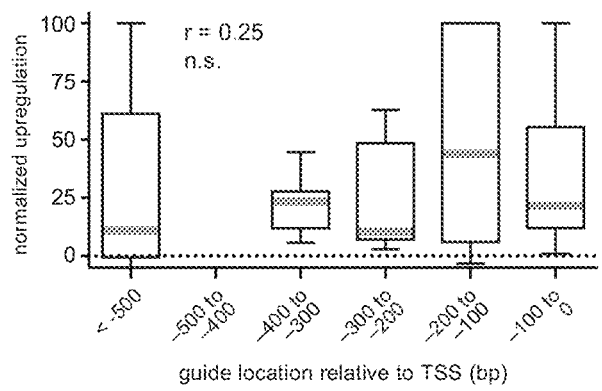

Long intergenic noncoding RNAs (lincRNAs) are a class of non-protein-coding transcripts longer than 200 bp[26]. While numerous lincRNAs have been identified by transcriptome sequencing, most of these molecules lack functional characterization. Nonetheless, some have so far been shown to play crucial roles in epigenetic regulation, cancer, and development[27]. Targeted activation of these transcripts would be a valuable tool for revealing their biological significance. To test whether SAM is able to activate lincRNAs, 3 targets with known functions (TINCR[28], HOTTIP[29], and PCAT[30]) and 3 with unknown functions (LINC00925, LINC00514 and LINC00028) were chosen. Similar to previous mRNA up-regulation experiments, RefSeq annotations were used to select 8 sgRNA target sites from the proximal promoter (−800 bp to +1) of each lincRNA. SAM indeed mediated significant up-regulation of lincRNA transcripts from 3-fold up-regulation of PCAT to 360-fold up-regulation of LINC00514 (FIG. 66a). Interestingly, and in contrast to mRNA data, no significant correlation between the distance of lincRNA-targeted guides to the TSS and fold activation was found (FIG. 66b). Possibly, this discrepancy could arise from the complex isoform structure of non-coding transcripts—the targets all have at least 2 isoforms with a different TSS reported[31].

Figure 72:
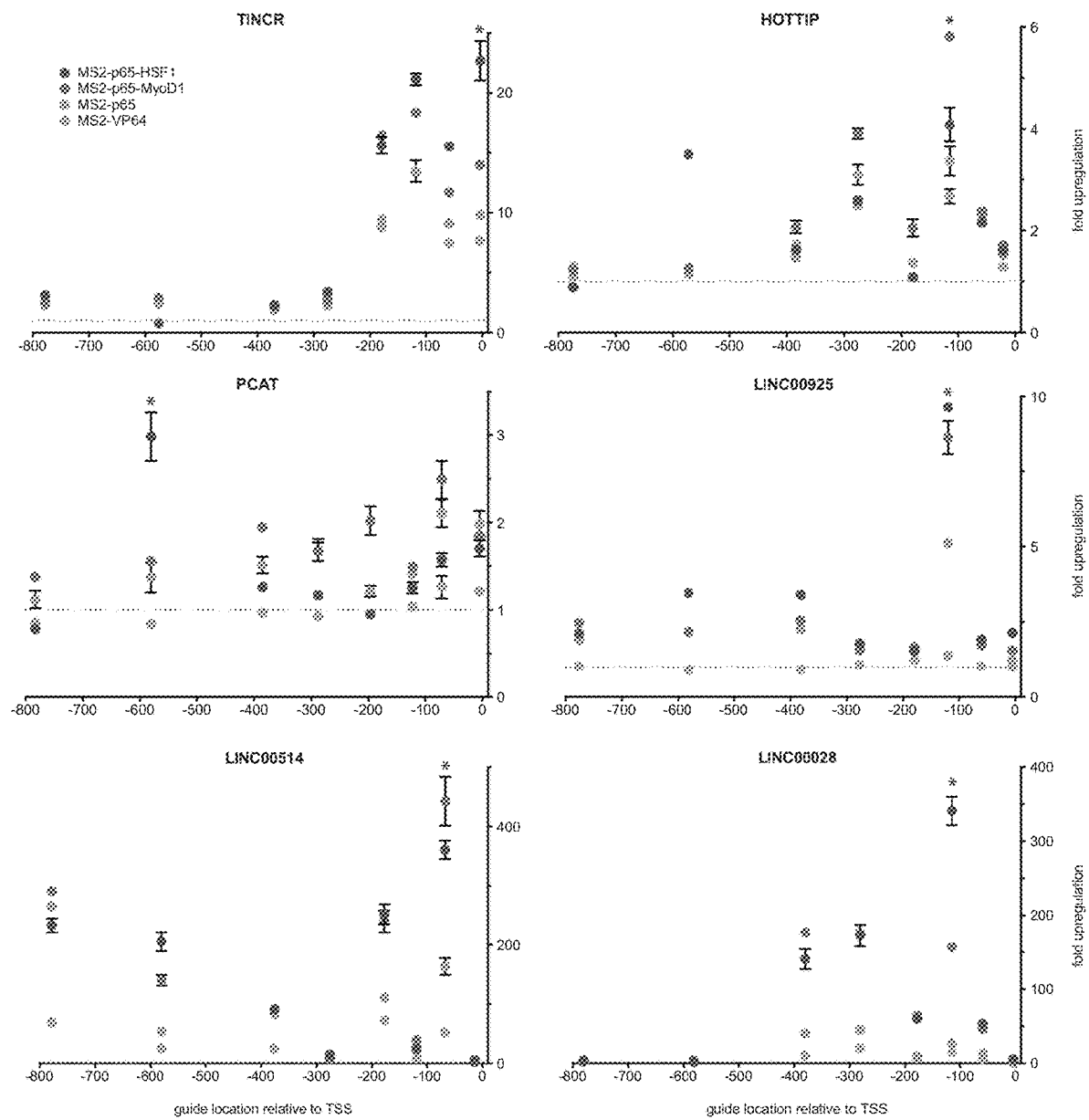
FIG. 72 shows activation of characterized and uncharacterized lincRNAs by SAM. Six lincRNAs were targeted using SAM. For each lincRNA, 8 sgRNAs were designed to target the proximal promoter region (+1 to −800 bp from the TSS) with 4 different MS2 activators (MS2-P65-HSF1, MS2-P65-MyoD1, MS2-P65, and MS2-VP64) in combination with dCas9-VP64. MS2 activators with a combination of 2 different domains (MS2-p65-HSF1 or MS2-p65-MyoD1) consistently provided the highest activation for each lincRNA, p<0.01 for MS2-p65-HSF1 or MS2-p65-MyoD1 vs. MS2-p65.

In order to find an effective activation domain for lincRNAs, the efficacy of different transactivator components was compared. A comparison of MS2 fusions to VP64 alone, p65 alone, p65-HSF1, and p65-MyoD1 for each of the 48 lincRNA-targeting guides was conducted (FIG. 72). Triple domain SAMs, dCas9-VP64 coupled with MS2-p65-HSF1 or MS2-p65-MyoD1, led to significantly higher activation than the dual domain SAM (dCas9-VP64 with MS2-P65) for the best guides for all 6 lincRNAs (p<0.01). Single domain SAM, dCas9-VP64 with MS2-VP64, performed worst for all 6 lincRNAs, suggesting that activation with a complex of synergistic domains may be important for efficient artificial up-regulation of non-coding RNAs based on the domains tested.

SAM Mediates Simultaneous Activation of Multiple Genes

Figure 73:
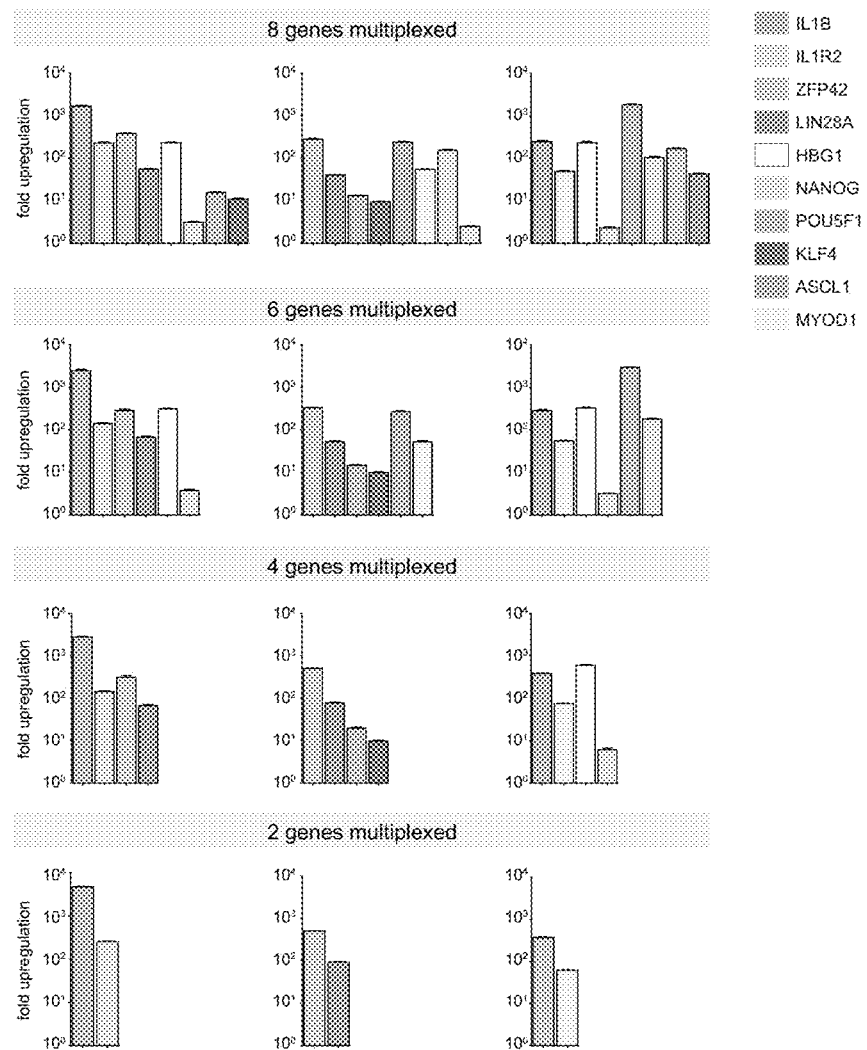
FIG. 73 shows multiplexed activation using SAM. Activation of a panel of 10 genes by combinations of 2, 4, 6, or 8 sgRNAs simultaneously. The mean fold up-regulation is shown on a $log_{10}$ scale. Error bars indicate S.E.M. and n=3.

In order to study the complexity of gene network and transcription regulation, tools for simultaneous modulation of gene expression at multiple loci are needed. This would enable targeting of multiple elements of a signaling pathway or sets of genes that coordinate signaling in disease states. To that end, it was sought to test whether SAM can activate multiple genes simultaneously, and characterize factors impacting multiplexing performance. Simultaneous activation of three sets of 2, 4, 6 or 8 genes and one set of 10 genes was tested (FIG. 73) by co-expressing combinations of sgRNAs. Successful activation of all genes (>2-fold) for all gene combinations tested, including simultaneous activation of 10 genes was observed (FIGS. 67a and 67b). Most genes (excluding IL1R2) exhibited a drop in the amount of up-regulation achieved when concurrently targeted with 9 other genes (FIGS. 67a and 67b). Interestingly, the relative activation levels of each gene changed between multiplex activation and single-gene activation experiments. For example, whereas NANOG ranked 5th among the 10 targeted genes during single-gene activation, it ranked 10th in the 10-plex activation experiment. Some genes showed no change or only a modest and gradual drop in activation when concurrently targeted alongside an increasing number of genes (e.g. IL1R2, MYOD1, ASCL1). Others, however, displayed a steep decrease in up-regulation when combined with even a single gene partner (e.g. LIN28A, IL1B, NANOG). These distinct behaviours between genes were observed generally, across different gene pairings (FIG. 73).

It was evaluated whether reduced activation of targets during multiplexing of 10 genes was due to the reduced amounts of sgRNA or SAM protein components available per gene. Surprisingly, diluting the sgRNA expression plasmid by 10-fold in single-gene activation experiments did not reduce activation for all genes (FIG. 67d). For example, activation for 4 out of 10 genes (IL1R2, KLF4, ASCL1, and MYOD1) increased by an average of 90% with 10x dilution of sgRNA expression plasmid. The remaining 6 genes were decreased by an average of 51%. Genes whose activation was reduced as a result of sgRNA dilution were also dampened by multiplexing (FIG. 67e; r=0.94, p<0.001).

Figure 74A:
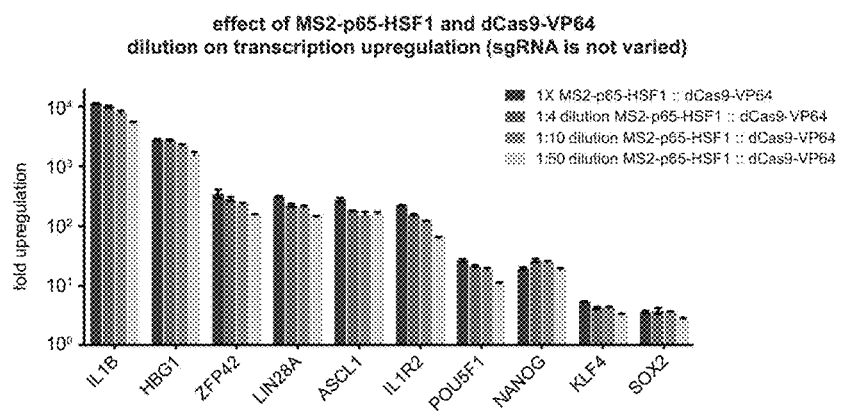
FIG. 74A-B shows activation of a panel of 12 genes as a function of the dosage of SAM components. a, Effect of MS2-P65-HSF1 and dCas9-VP64 dilution, at 1:1, 1:4, 1:10, and 1:50 of the original dosage for each component, on the effectiveness of transcription up-regulation. The amount of sgRNA expression plasmid is kept constant. b, Effect of diluting all three SAM components (dCas9-VP64, MS2-p65-HSF1, and sgRNA2.0) at 1:4, 1:10, and 1:50 of the original dosage for each component. Fold up-regulation is calculated using GFP-transfected cells as the baseline. Error bars indicate S.E.M. and n=3.
Figure 74B:
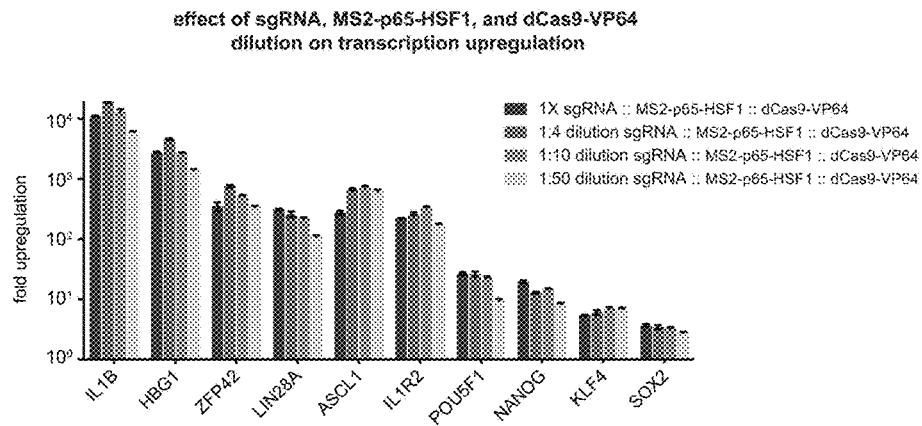

The activation efficiency of SAM was generally stable to dilution of its protein components (dCas9-VP64 and MS2-p65-HSF1). Reducing the amount of expression plasmids for both components by 10-fold led to an average drop of 26% in activation efficiency (FIG. 74a). Activation efficiency was particularly stable when all three components (including sgRNA) were diluted, retaining on average 100% activation efficiency across a 50-fold dilution range (FIG. 74b). The finding that SAM is highly efficient even at low transfection concentrations was particularly promising for application in genome-scale pooled screens, which rely on single copy lentiviral integration.

Development of a Genome-Scale Pooled Transcription Activation Screen

The ability to activate target genes using a single sgRNA opens the possibility of conducting pooled genome-scale pooled transcription activation screening. As a first step towards developing a SAM-based screen, all three components were cloned into lentiviral vectors (FIG. 68a). Each vector encodes a unique selection marker (Blast, Hygro, and Zeocin or Puromycin) to enable selection of cells co-expressing all three SAM components. To assess the efficiency of SAM when delivered via lentivirus at low multiplicity of infection (MOI), three validated genes were targeted: MYC, which is weakly activated; and KLF4 and MYOD1, which are only moderately activated. HEK293FT cells were co-transduced with lenti-dCas9-VP64 and lenti-MS2-p65-HSF1 at MOI<1 and concurrently selected with Blast and Hygro for 7 days. dCas9-VP65- and MS2-p65-HSF1-expressing cells were then transduced with lentiviral sgRNA vectors (lenti-sgRNA) at low MOI (<0.2) and selected for successfully transduced cells using either Puromycin or Zeocin. Target gene expression levels were measured four days post-transduction. All three genes were efficiently upregulated to levels comparable (MYOD1) or greater than those observed after transient SAM transfection (MYC and KLF4). Notably, expression levels achieved with Puromycin or Zeocin resistance markers on the sgRNA construct were not equal (FIG. 68b).

Having validated lentiSAM constructs (lenti-dCas9-VP64, lenti-MS2-p65-HSF1, and lenti-sgRNA), a genome-scale sgRNA library targeting every coding isoform from the RefSeq database (23430 isoforms) was designed. 3 sgRNA per isoform were designed and target sites within 200 bp upstream of the TSS, which was previously determined to provide more efficient activation (FIG. 65d), were chosen. The final library contained 70,290 guides, and two separate libraries with Zeocin (lenti-sgRNA-Zeo) or Puromycin (lenti-sgRNA-Puro) resistance were generated. As gene activation can have both a negative and positive effect on proliferation and cell survival a genome-wide screen for effectors of cellular growth was conducted. A polyclonal A375 melanoma cell line constitutively expressing both dCas9-VP64 and MS2-p65-HSF1 components was generated and these cells were transduced with a genome-scale lenti-sgRNA-Zeo library at a MOI of 0.2 (FIG. 68c). Genomic DNA was extracted 3 and 21 days after transduction by the sgRNA lentivirus, and guide counts were determined by NGS. $\text{Log}_e$ normalized guide counts for these two timepoints were compared. As expected for a population under selection, the distribution of guide counts displayed increased variance after 21 days in culture, with a large fraction of guides exhibiting depletion (FIG. 68d) (Wilcoxon rank sum test, p<0.0001). Enrichment of functional gene categories for the top 1000 depleted sgRNAs was analyzed, as well as the top 1000 depleted genes (determined based on the average depletion of all three guides targeted to a given gene), using Ingenuity pathway analysis. Categories with p<0.01 after Benjamini-Hochberg FDR correction are shown in FIG. 68e. Enrichment for cancer and pluripotency related gene categories (including PTEN[32] and STAT3[33] signaling pathways, which have been implicated in cancer regulation) was observed. These results suggest that dysregulation of members of these gene categories may negatively impact melanoma proliferation and that SAM can be used for depletion screening.

Figure 69A:
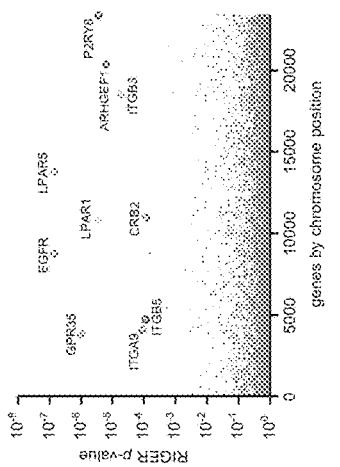
FIG. 69A-F shows genome-scale gene activation screening identifies mediators of BRAF inhibitor resistance. a, Box plot showing the distribution of sgRNA2.0 frequencies at different time points post lentiviral transduction, with and without treatment with PLX-4720. Vehicle is DMSO. Two infection replicates are shown. b, Scatterplot showing enrichment of specific sgRNA2.0s after PLX-4720 treatment. c, Identification of top candidate genes using the RIGER P value analysis (KS method) based on the average of both infection replicates. Genes are organized by positions within chromosomes. d, RIGER P values for the top 100 hits from SAM and GeCKO screens, for gene perturbations resulting in BRAF inhibitor resistance. e, The top 10 shared candidates from Puromycin and Zeocin screens, identified using RIGER are shown. For both screens, the percent of unique sgRNA2.0s targeting each gene that are in the top 5% of all enriched sgRNA2.0s is plotted. f, Heat map of z-scores with each column representing a different BRAF$^{V600}$ melanoma short-term culture and rows representing expression of BRAF-inhibitor marker genes and signatures (upper panel), expression of SAM top screen hits (middle panel) and screen signature scores (see methods for signature generation using single-sample Gene Set Enrichment Analysis) (bottom panel). A distinct transcriptional state of genes and signatures represents BRAF-inhibition resistance as previously defined (Konieczkowski, D. J. et al. Cancer discovery 4, 816-827, doi:10.1158/2159-8290.CD-13-0424 (2014)). Columns are sorted by MITF expression with high expression indicating BRAF inhibitor sensitivity. Top hits from the SAM screen are significantly associated with the resistant state (MITF low expression and high levels of resistance markers). A subset of samples were previously tested for PLX sensitivity (blue text/arrows) and resistance (red text/arrows). IC: Information Coefficient (see methods for details). P-values are generated using a permutation test (n=10,000).

Using Genome-Scale Transcription Activation Screen to Identify Genes Involved in BRAF Inhibitor Resistance Previously it has been demonstrated that genome-scale screening using Cas9-mediated gene knockout can facilitate the identification of loss-of-function mutations that confer BRAF inhibitor resistance in a cell line model of melanoma[14]. The complementary genome-scale transcription activation screen using SAM would enable the identification of gain-of-function perturbations involved in melanoma drug resistance. To test the efficiency of SAM for genome-wide positive selection screening one aim was to identify genes implicated in the development of BRAF inhibitor resistance in $\text{BRAF}^{V600E}$ mutant melanoma. The A375 melanoma cell line harbors the $\text{BRAF}^{V600E}$ mutation and is naturally sensitive to BRAF inhibitors such as PLX4720 (PLX) and the closely related commercial therapeutic Vemurafenib. Cells harboring sgRNAs that activate genes leading to PLX resistance should therefore be enriched after continued culture in the presence of the drug, whereas no such effect should be observed in cells treated with vehicle only. Normalized guide counts for the input sgRNA-zeo library at the baseline time point (3 days post infection) as well as 14 days post treatment with either PLX or vehicle were analyzed. The sgRNA distribution was significantly different between cells treated with PLX and vehicle for two independent infection replicate screens, with the majority of sgRNAs exhibiting a reduced representation and a small set of guides showing high enrichment for PLX treated cells (Wilcoxon rank sum test, P<0.0001, median −1.3 for PLX vs. DMSO)(FIG. 69a).

Figure 69B:
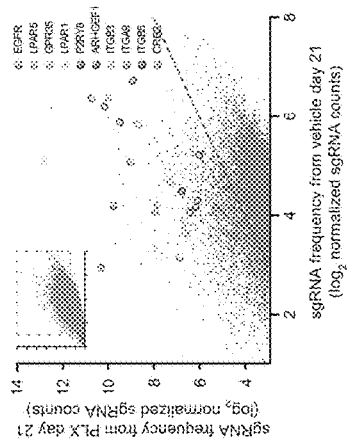
Figure 69D:
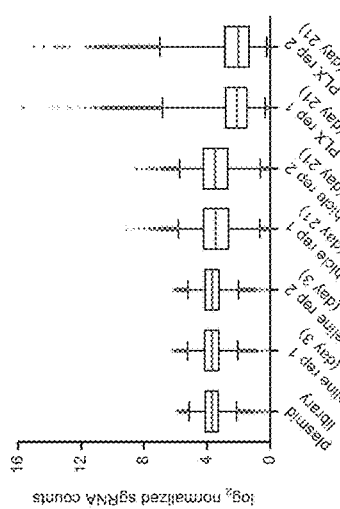
Figure 69C:
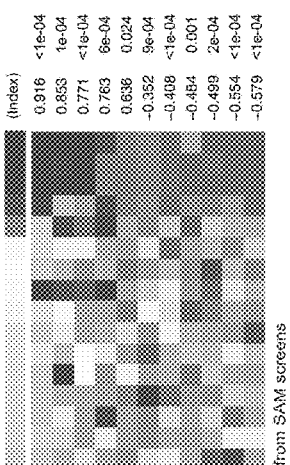
Figure 75A:
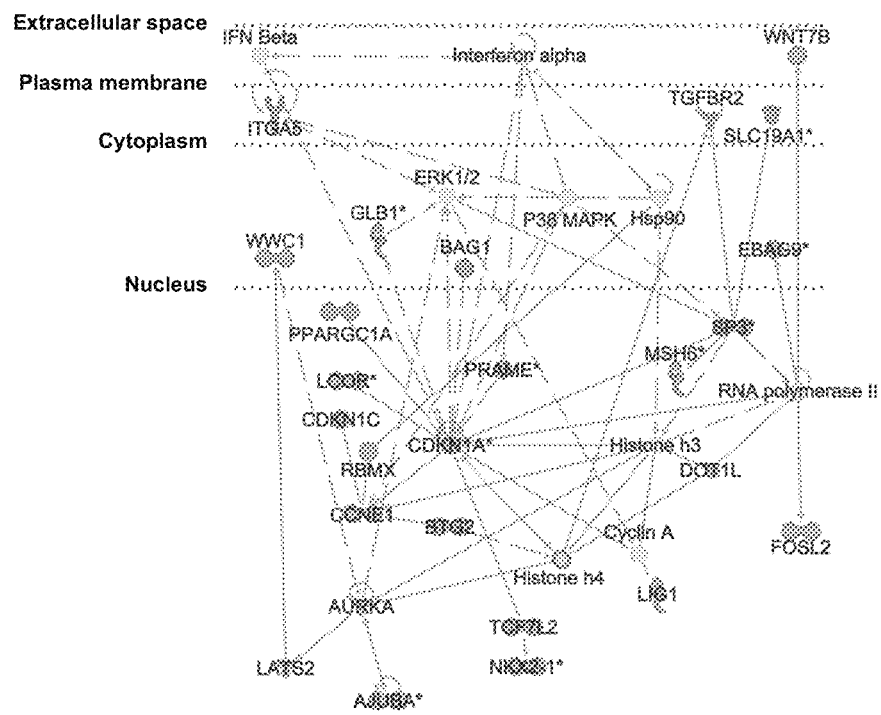
FIG. 75A-B shows components of Cancer survival and proliferation pathways are depleted in a genome-wide SAM screen. IPA analysis on the top 300 depleted genes based on average depletion of all 3 guides/gene resulted in 2 networks with scores >30. Depleted genes are indicated in red. a, network score=39 with 26 depleted genes in the network. b, network score=37 with 25 depleted genes in the network. Components on all layers of both networks exhibit depletion.
Figure 75B:
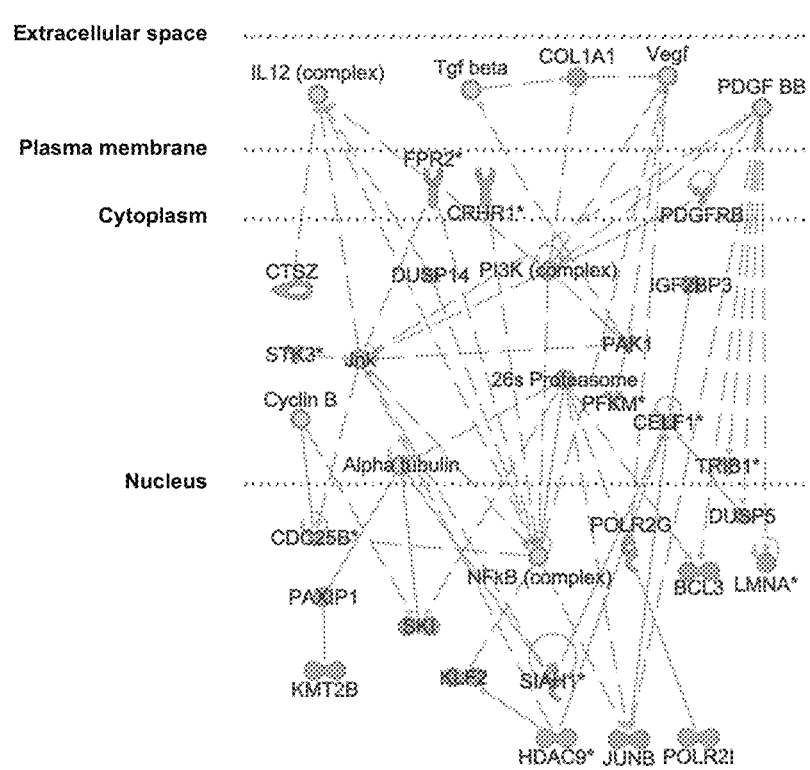

For a number of gene targets, several sgRNAs for the same gene were enriched in PLX-treated cells (FIG. 69b), suggesting the importance of these genes for the formation of PLX resistance. To determine genes exhibiting consistently high enrichment across multiple sgRNAs, the RNAi Gene Enrichment Ranking (RIGER) algorithm (FIG. 69c) was employed. The 10 most significant hits were distributed throughout the genome (FIG. 69c). 50% of the top 20 RIGER hits were replicated in a validation screen using puro selection, rather than zeo, on the sgRNA library (FIG. 75). The significance of the p-values of the top 100 RIGER hits was comparable to those observed for GeCKO screening[14], indicating that the results obtained from the SAM gain-of-function activation screen have similar statistical power compared to Cas9 nuclease-based knockout screening (FIG. 69d). In addition, for the top 10 shared hits between zeo and puro screens, the fraction of effectively enriched guides per gene (present in the top 5% of all guides) was very high with 97% for zeo and 81% for puro (89%±10.7% overall, compared to 78%±27% for the top 10 GECKO hits, FIG. 69e).

Figure 69F:
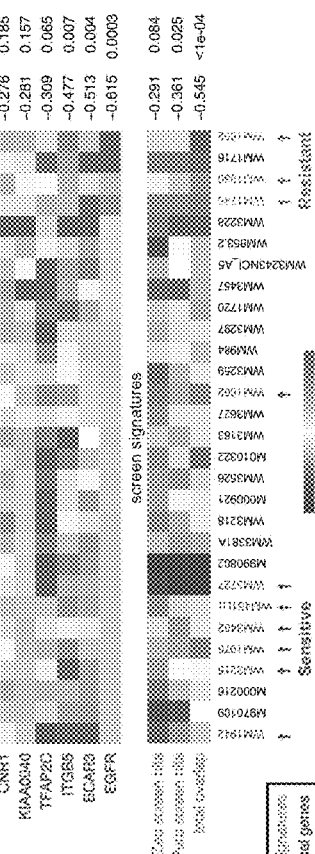
Figure 69E:
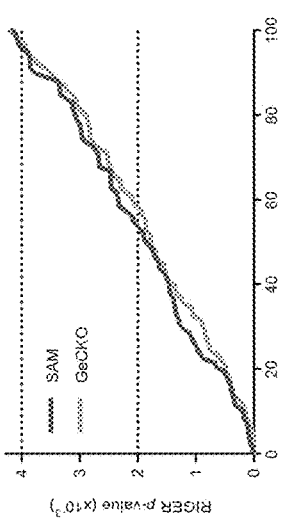

Ectopic expression of the top hit from both screens—EGFR—was previously shown to cause PLX resistance in tumor types harboring $\text{BRAF}^{V600E}$ mutations by activating AKT in a pathway parallel to BRAF[34]. In addition, patient-derived BRAF mutant melanomas were sensitized to PLX when treated with EGFR and AKT inhibitors[35]. Furthermore, four out of the top 10 hits from the first screen belong to the family of G protein-coupled receptors (GPR35, LPAR1, LPAR5, and P2RY8). GPCR also emerged as the top-ranked protein class conferring resistance to multiple MAP kinase inhibitors in melanoma cells in a recent screen using cDNA overexpression by Johannessen et al.[36] GPR35 and LPAR1 have previously been found to mediate PLX resistance in A375 cells when overexpressed via cDNA[36]. GPR35, LPAR1 and LPAR5 share Gα13 as a downstream target[37,38] and induce cell proliferation through the ERK/GSK3β/β-catenin pathway, leading to a growth advantage in multiple cancer types[39,40]. Although the exact molecular mechanism for P2RY8 action has not been identified, P2RY8 is abundantly expressed in leukemia cells[41]. Overexpression of P2RY8 in NIH3T3 cells with cDNA led to increased CREB, Elk-1, c-Fos, and c-Myc activity, suggesting that P2RY8, may evoke cell proliferation through the ERK pathway[41]. RAF-independent activation of ERK has previously been shown as a resistance mechanism to BRAF inhibitors[42]. A second family of proteins present in the top 20 hits of both screens are Rho guanine nucleotide exchange factors (ARHGEF1 and ARHGEF2) which also act on Gα13, downstream of GPCR. The activation of the GPCR pathway was shown to act as an independent mechanism for resistance to BRAF inhibition therapy through cAMP/PKA-mediated activation of transcription through CREB and ATF1[36]. While only two of the top hits (GPR35 and LPAR1) overlap with the top hits from the Johannessen screen[36], many novel members of the GPCR pathway enriched in the top hits were in agreement with a model where GPCR pathway activation can mediate resistance to MAPK pathway inhibitors. Additionally, top hits include multiple integrin genes (ITGA9, ITGB3, and ITGB5) that have roles in tumorigenesis and malignancy. Particularly, all three integrin hits are capable of driving MAPK signaling and promoting malignancy, anchorage independence, and migration in melanoma and various carcinomas[43-46]. Additionally, ITGB3 is capable of driving cancerous cells towards a stem-like state through NF-κB pathway activation, which has been shown to mediate resistance to BRAF-inhibition therapy[47] (FIG. 69f). Therefore, these integrin top hits may play a role in circumventing BRAF inhibition by activating accessory pathways known to promote resistance and re-activate the MAPK downstream of RAF to promote malignancy.

To verify the biological relevance of the top hits from the genome-wide screen, a collection of gene expression data from BRAF$^{v600}$-mutant melanoma cell lines in the Cancer Cell Line Encyclopedia (CCLE)[48], short-term cultures of patient tumors[49], and a collection of primary and metastatic patient melanoma samples from The Cancer Genome Atlas (TCGA) (https://tcga-data.nci.nih.gov/tcga/) was examined. As shown previously[47], a distinct transcriptional state defines BRAF-inhibition sensitivity/resistance where sensitive and resistant states are described by activation of endogenous MITF/associated markers (e.g. PMEL) and NF-κB-pathway activity/associated markers (e.g. AXL), respectively (FIG. 6f). Using gene expression profiles from 29 melanoma short-term cultures, it was found that top genes from the SAM screen were significantly co-expressed within the resistant state and that a gene expression signature representing the top hits was predictive of this BRAF-inhibitor resistant transcriptional state (FIG. 69f; p<0.0001 for overlapping hits from zeo and puro screens).

Figure 77:
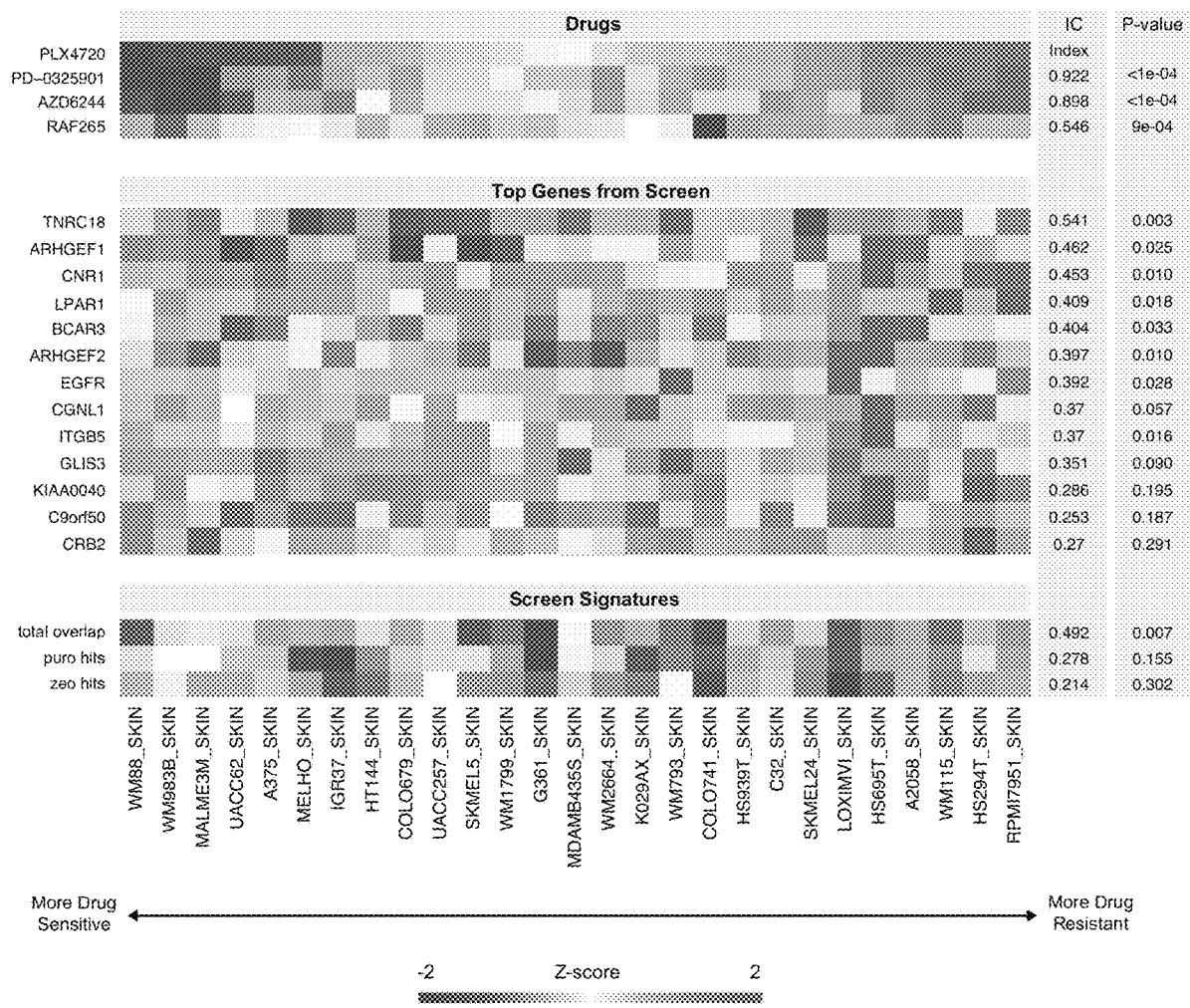
FIG. 77 shows validation of top screen hits using Cancer Cell Line Encyclopedia expression and pharmacological data from additional melanoma cell lines. Heat map of z-scores, with each column representing a different $BRAF^{V600}$ melanoma cell line and rows representing sensitivity to different drugs (upper panel), expression of SAM top screen hits (middle panel), and SAM screen signature scores (bottom panel, see methods for signature generation). Drug sensitivity is measured as 8-Activity Area (AA) (Barretina, J. et al. Nature 483, 603-607, doi:10.1038/nature11003 (2012)). The melanoma cell lines are sorted by PLX drug sensitivity where a lower value (blue) corresponds to increased sensitivity. Also displayed are the sensitivities to related MAPK inhibitors. There is a fraction of cell lines that demonstrate resistance to MAPK inhibitors and in these cell lines, many of the SAM top hits are highly expressed. The signatures comprised of these top hits also are highly scored within the resistant cell lines. Associations are measured using the information coefficient (IC) between PLX-4720 sensitivity (index) and each of the features and p-values are determined using a permutation test. RAF inhibitors: PLX4720 and RAF265; MEK inhibitors: AZD6244 and PD-0325901.
Figure 78:
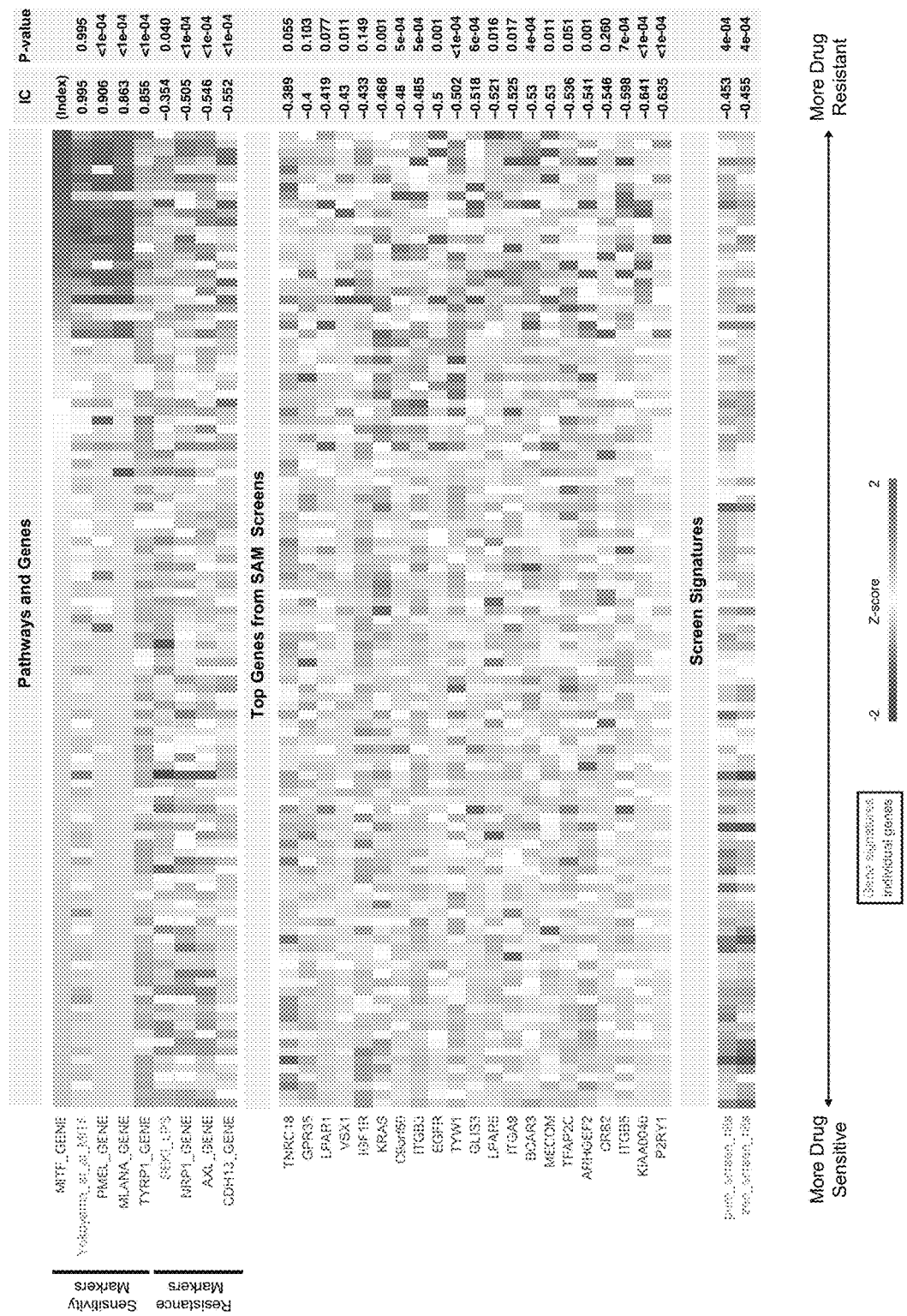
FIG. 78 shows validation of top screen hits in primary and metastatic melanoma patient samples from The Cancer Genome Atlas. Heat map of z-scores with each column representing a different $BRAF^{V600}$ patient melanoma (primary or metastatic) and rows representing expression of gene/signature markers for BRAF-inhibitor sensitivity (top panel), expression of SAM top screen hits (middle panel) and screen signature scores (see methods for signature generation) (bottom panel). Because no pharmacological data is available for these TCGA melanoma samples, TCGA gene expression data is first mapped onto a previously defined transcriptional state for BRAF-inhibitor sensitivity/resistance based on a panel of gene markers and signatures (Konieczkowski, D. J. et al. Cancer discovery 4, 816-827, doi:10.1158/2159-8290.CD-13-0424 (2014)). The expression of top SAM screen individual hits is increased and significantly associated with tumors displaying a resistant state (defined as low MITF expression and high expression of resistant markers/signatures). Signatures comprised of the top genes from the SAM screens also are significantly associated with the resistant tumors. The panel of melanoma samples is sorted by decreasing MITF expression where a higher value (red) corresponds to samples that are more sensitive to BRAF inhibition. Associations are measured using the information coefficient (IC) between MITF expression (index) and each of the features and p-values are determined using a permutation test.

The expression of the top hits in 27 BRAF$^{v600}$-mutant melanoma cell lines from CCLE for which gene expression and pharmacological data were available was additionally investigated. The gene expression of the top hits from the activation screen are enriched and significantly associated with resistance to BRAF-inhibition (PLX4720) as is the top-hit signature from the SAM screens (FIG. 77; p=0.007 for overlapping hits from zeo and puro screens). To confirm that the top hits were representative of a resistant state in vivo, gene expression data from 113 primary and metastatic melanoma samples from TCGA (FIG. 78) was analyzed. The same gene and signature markers as described above was used to define sensitive and resistant transcriptional states and found that top hits and signatures from the SAM screens were significantly associated with a BRAF-inhibitor resistant phenotype (FIG. 78, p<0.0001 for both zeo and puro screens). Thus, both in vitro (short-term cultures of patient melanoma samples and a panel of established melanoma cell lines) and in vivo (TCGA), the hits expand the understanding of the transcriptional state associated with BRAF-inhibition resistance with potentially novel therapeutic targets.

In summary, a structure-guided approach has been taken to design a dCas9-based transcription activation system for achieving robust, single sgRNA-mediated gene up-regulation. By engineering the sgRNA to incorporate protein-interacting aptamers, a synthetic transcription activation complex consisting of multiple distinct effector domains that more closely mimic natural transcription activation processes was assembled. Additional developments may be able to take advantage of the modularity and customizability of the sgRNA scaffold to establish a series of sgRNA scaffolds with different aptamers for recruiting distinct types of effectors. For instance, replacement of the MS2 stem-loops with PP7-interacting stem-loops may be used to recruit transcription repression elements.

The exemplary steps toward defining selection rules for potent sgRNAs provided in this example allows one skilled in the art to reveal additional selection criteria, such as sequence-intrinsic properties (FIG. 79), that are useful for guide efficacy.

Further characterization and improved understanding of the targeting specificity will also be useful for continued utility of Cas9 or SAM. Recent analysis of genome-wide dCas9-binding revealed significant concentration-dependent off-target binding[50].

Application of the Cas9 transcription activation complex, either in the context of individual gene perturbation or as genome-scale gene activation libraries, further allows for the dissection of many types of genetic elements, ranging from protein-coding genes to non-coding lincRNA elements. Furthermore, combining SAM with Cas9 mediated genome editing or dCas9-mediated gene repression allows for powerful approaches for studying gene interactions in diverse biological processes in contexts spanning from development and regeneration to many diseases.

Transient Transfection Experiments:

Neuro-2a cells (Sigma-Aldrich) were grown in media containing 1:1 ratio of OptiMEM (Life Technologies) to high-glucose DMEM with GlutaMax and sodium pyruvate (Life Technologies) supplemented with 5% HyClone heat-inactivated FBS (Thermo Scientific), 1% penicillin/streptomycin (Life Technologies), and passaged at 1:5 every 2 days.

HEK293FT cells (Life Technologies) were maintained in high-glucose DMEM with GlutaMax and sodium pyruvate (Life Technologies) supplemented with 10% heat-inactivated characterized HyClone fetal bovine serum (Thermo Scientific) and 1% penicillin/streptomycin (Life Technologies). Cells were passaged daily at a ratio 1:2 or 1:2.5. For gene activation experiments, 20,000 HEK293FT cells/well were plated in 100 µL media in poly-D-lysine coated 96-well plates (BD BioSciences). 24 hours after plating, cells were transfected with a 1:1:1 mass ratio of:

sgRNA plasmid with gene-specific targeting sequence or pUC19 control plasmid

MS2-effector plasmid or pUC19.

dCas9 plasmid, dCas9-effector plasmid, or pUC19.

A total plasmid mass of 0.3 ug/well was transfected using 1.5 uL/well Lipofectamine 2000 (Life Technologies) according to the manufacturer's instructions. Culture medium was changed 5 hours after transfection. 48 hours after transfection, cell lysis and reverse transcription were performed using a Cells-to-Ct kit (Life Technologies). Relative RNA expression levels were quantified by reverse transcription and quantitative PCR (qPCR) using Taqman qPCR probes (Life technologies) and Fast Advanced Master Mix (Life Technologies). qPCR was carried out in 5 uL multiplexed reactions and 384-well format using the LightCycler 480 Instrument II. Data was analyzed by the $\Delta\Delta C_t$ method: target Ct values (FAM dye) were normalized to GAPDH Ct values (VIC dye), and fold changes in target gene expression were determined by comparing to GFP-transfected experimental controls.

Lentivirus Production:

HEK293T cells (Life Technologies) were cultured as described above for HEK293FT cells. 1 day prior to transfection, cells were seeded at ~40% confluency (12 T225 flasks for library scale production, 1 T75 flask for individual guide production). Cells were transfected the next day at ~80-90% confluency. For each flask, 20 ug of plasmid containing the vector of interest, 10 ug of pVSVG, and 15 ug of psPAX2 (Addgene) were transfected using 100 uL of Lipofectamine 2000 and 200 uL Plus Reagent (Life Technologies). 5 h after transfection the media was changed. Virus supernatant was harvested 48 h post-transfection, filtered with a 0.45 μm PVDF filter (Millipore), aliquoted, and stored at −80° C.

Lentiviral Transduction:

A375 cells (ATCC) were cultured in RPMI 1640 (Life Technologies) supplemented with 10% FBS (Seradigm) and 1% penicillin/streptomycin (Life Technologies) and passaged every other day at a 1:4 ratio. Cells were transduced with lentivirus via spinfection in 12-well plates. $3 \times 10^6$ cells in 2 mL of media supplemented with 8 ug/mL polybrene (Sigma) were added to each well, supplemented with lentiviral supernatant and centrifuged for 2 h at 1000 g. 24 h after spinfection, cells were detached with TrypLE (Life Technologies) and counted. Cells were replated at low density ($7.5 \times 10^6$ cells per T225 Flask) and a selection agent was added either immediately (zeocin, blasticidin and hygromycin, all Life technologies) or 3 h after plating (puromycin). Concentrations for selection agents were determined using a kill curve: 0.5 ug/ml puromycin, 200 ug/mL zeocin, 2 ug/mL blasticidin, and 300 ug/mL hygromycin. Media was refreshed on day 2 and cells were passaged every other day starting on day 4 after replating. The duration of selection was 4 days for puromycin and 7 days for zeocin, hygromycin and blasticidin. Lentiviral titers were determined by spinfecting cells with 6 different volumes of lentivirus ranging from 0 to 600 uL and counting the number of surviving cells after a complete selection (3-6 days).

Design and Cloning of SAM Library:

RefSeq coding gene isoforms with a unique TSS (total of 23430 isoforms) were targeted with three guides each for a total library of 70300 guides. Guides were designed to target the first 200 bp upstream of each TSS and subsequently filtered for GC content >25% and minimal overlap of the target sequence. After filtering, the remaining guides were scored according to predicted off-target matches based on Hsu et al. and three guides with the best off-target scores were selected. Cloning of the SAM sgRNA libraries was performed as previously described[14] with a minimal representation of 100 transformed colonies/guide.

Depletion and PLX Screen:

A375 cells stably integrated with SAM Cas9 and effector components were transduced with SAM sgRNA libraries as described above at an MOI of 0.2, with a minimal representation of 500 transduced cells/guide. Cells were maintained at >1000 cells/guide during subsequent passaging. At 7 DPI (complete selection, see above), cells were split into vehicle (DMSO) and PLX4720 conditions (2 uM PLX dissolved in DMSO, Selleckchem). Cells were passaged every 2 days for a total of 14 days of drug treatment. >1000 cells/guide were harvested as a baseline at 3 DPI (4 days before treatment) and at 21 DPI (after 14 days of treatment) for gDNA extraction. Genomic DNA was extracted using the Zymo Quick-gDNA midi kit (Zymo Research). PCR of the virally integrated guides was performed on gDNA at the equivalent of >500 cells/guide in 96 parallel reactions using NEBnext High Fidelity 2× Master Mix (New England Biolabs) in a single-step reaction of 22 cycles. Primers are listed below:

forward primer:
(SEQ ID NO: 223)
AATGATACGGCGACCACCGAGATCTACACTCTTTCCCTACACGACGCTCTT CCGATCTNNNNNNNN(1-10 bp stagger)GCTTTATATATCTTGTGG

AAAGGACGAAACACC 8 bp Barcode Indicated in Red reverse primer:
(SEQ ID NO: 224)
CAAGCAGAAGACGGCATACGAGATNNNNNNNNGTGACTGGAGTTCAGAC

GTGTGCTCTTCCGATCTGCCAAGTTGATAACGGACTAGCCTT 8 bp Index Read Barcode Indicated in Red PCR products from all 96 reactions were pooled, purified using Zymo-Spin™ V with Reservoir (Zymo research) and gel extracted using the Zymoclean™ Gel DNA Recovery Kit (Zymo research). Resulting libraries were deep-sequenced on Illumina Miseq and Hiseq platforms with a total coverage of >35 million reads passing filter per library.

NGS and Screen Hits Analysis:

NGS data were demultiplexed using unique index reads. Guide counts were determined based on perfectly-matched sequencing reads only. For each condition, guide counts were normalized to the total number of counts per condition, and $\log_2$ counts were calculated based on these values. Ratios of counts between conditions were calculated as $\log_2((\text{count } 1+1)/(\text{count } 2+1))$ based on normalized counts.

RIGER analysis was performed using GENE-E based on the normalized day 14 log 2 ratios (PLX/DMSO) averaged over two independent infection replicates. All RIGER analysis used the Kolmogorov-Smirnov method as described previously[51], except for FIG. 6c, where the weighed average method was used in order to enable comparison to GeCKO values determined by that method.

Gene Expression and Pharmacological Validation Analysis:

Gene expression data (CCLE, TCGA, short-term cultures) and pharmacological data (CCLE, short-term cultures) were analyzed to better understand the biological relevance of the top gene hits from the SAM screens. In the CCLE dataset[48], gene expression data (RNA-sequencing) and pharmacological data (activity area for MAPK pathway inhibitors) from $BRAF^{V600}$ mutant melanoma cell lines were used to compute the association between PLX-4720 resistance and the gene expression of each of the top hits. Additionally, gene expression signatures comprised of the top hits were generated using single-sample Gene Set Enrichment Analysis (ssGSEA)[52,53], and the associations between PLX-4720 resistance and these signatures were computed.

Gene expression data (Affymetrix GeneChip HT-HGU133) and PLX-4720 pharmacological data ($GI_{50}$; only for a subset of the samples) from short term melanoma cultures (STC)[49] was also used for plotting the gene expression of top hits and their ssGSEA signature scores. Expression data for the STC samples were collapsed to maximum probe value per gene and preprocessed using robust spline normalization.

Gene expression (RNA-sequencing) and genotyping data were collected from 113 $BRAF^{V600}$-mutant primary and metastatic patient tumors from The Cancer Genome Atlas (https://tcga-data.nci.nih.gov/tcga/) and this data was similarly used for determining the association between resistance and the expression of top hits/ssGSEA signature scores. Because pharmacological data was not available for the STCs (only a subset had PLX-4720 data) and the TCGA melanoma samples, a transcriptional state was plotted using marker genes and signatures[47] in order to identify which samples were resistant to BRAF-inhibition.

Single Sample Gene Set Enrichment Analysis:

While there was a significant association between the overexpression of some of the top individual SAM screen hits and resistance in three external cancer datasets, a more robust scoring system independent of any single gene was sought. Gene expression signatures were generated based on the set of top hits from each of the two SAM screens and for the overlap between them. Using single-sample Gene Set Enrichment analysis (ssGSEA), a score was generated for each sample that represents the enrichment of the SAM screen gene expression signature in that sample and the extent to which those genes are coordinately up- or down-regulated. Additionally, signature gene sets from the Molecular Signature Database (MSigDB)[54] were used in order to fully map the transcriptional BRAF-inhibitor resistant/sensitive states in the short-term culture and TCGA datasets as previously described[47].

Information Coefficient for Measuring Associations in External Datasets:

To measure correlations between different features (signature scores, gene expression, or drug-resistance data) in the external cancer datasets, an information-theoretic approach (Information Coefficient; IC) was used and significance was measured using a permutation test (n=10,000), as previously described[47]. The IC was calculated between the feature used to sort the samples (columns) in each dataset and each of the features plotted in the heatmap (pharmacological data, gene expression, and signature scores).

sgRNA Sequence Analysis:

Depletion for each sgRNA was calculated as the ratio of counts (see "NGS and screen hits analysis") between day 3 and day 21. sgRNAs corresponding to genes with significant depletion (p<=0.05 by RIGER analysis) in sgRNA-puro and sgRNA-zeo libraries were selected for analyses. Selected sgRNA were counted for nucleotide occurrence in the sgRNA sequence, and for each nucleotide type, the correlation and significance with the sgRNA ratio of counts was calculated by Ordinary Least Squares linear regression.

REFERENCES

Specific to Example 20

1 Berns, K. et al. A large-scale RNAi screen in human cells identifies new components of the p53 pathway. Nature 428, 431-437, doi:10.1038/nature02371 (2004).
2 Boutros, M. et al. Genome-wide RNAi analysis of growth and viability in Drosophila cells. Science 303, 832-835, doi:10.1126/science.1091266 (2004).
3 Horvath, P. & Barrangou, R. CRISPR/Cas, the immune system of bacteria and archaea. Science 327, 167-170, doi:10.1126/science.1179555 (2010).
4 Beerli, R. R. & Barbas, C. F., 3rd. Engineering polydactyl zinc-finger transcription factors. Nature biotechnology 20, 135-141, doi:10.1038/nbt0202-135 (2002).
5 Beerli, R. R., Segal, D. J., Dreier, B. & Barbas, C. F., 3rd. Toward controlling gene expression at will: specific regulation of the erbB-2/HER-2 promoter by using polydactyl zinc finger proteins constructed from modular building blocks. Proceedings of the National Academy of Sciences of the United States of America 95, 14628-14633 (1998).
6 Zhang, F. et al. Efficient construction of sequence-specific TAL effectors for modulating mammalian transcription. Nature biotechnology 29, 149-153, doi:10.1038/nbt.1775 (2011).
7 Gilbert, L. A. et al. CRISPR-mediated modular RNA-guided regulation of transcription in eukaryotes. Cell 154, 442-451, doi:10.1016/j.cell.2013.06.044 (2013).
8 Konermann, S. et al. Optical control of mammalian endogenous transcription and epigenetic states. Nature 500, 472-476, doi:10.1038/nature12466 (2013).
9 Maeder, M. L. et al. Targeted DNA demethylation and activation of endogenous genes using programmable TALE-TET1 fusion proteins. Nature biotechnology 31, 1137-1142, doi:10.1038/nbt.2726 (2013).
10 Maeder, M. L. et al. CRISPR RNA-guided activation of endogenous human genes. Nature methods 10, 977-979, doi:10.1038/nmeth.2598 (2013).
11 Mali, P. et al. CAS9 transcriptional activators for target specificity screening and paired nickases for cooperative genome engineering. Nature biotechnology 31, 833-838, doi:10.1038/nbt.2675 (2013).
12 Perez-Pinera, P. et al. RNA-guided gene activation by CRISPR-Cas9-based transcription factors. Nature methods 10, 973-976, doi:10.1038/nmeth.2600 (2013).
13 Perez-Pinera, P. et al. Synergistic and tunable human gene activation by combinations of synthetic transcription factors. Nature methods 10, 239-242, doi:10.1038/nmeth.2361 (2013).
14 Shalem, O. et al. Genome-scale CRISPR-Cas9 knockout screening in human cells. Science 343, 84-87, doi: 10.1126/science.1247005 (2014).
15 Wang, T., Wei, J. J., Sabatini, D. M. & Lander, E. S. Genetic screens in human cells using the CRISPR-Cas9 system. Science 343, 80-84, doi:10.1126/science.1246981 (2014).
16 Koike-Yusa, H., Li, Y., Tan, E. P., Velasco-Herrera Mdel, C. & Yusa, K. Genome-wide recessive genetic screening in mammalian cells with a lentiviral CRISPR-guide RNA library. Nature biotechnology 32, 267-273, doi:10.1038/nbt.2800 (2014).
17 Nishimasu, H. et al. Crystal structure of Cas9 in complex with guide RNA and target DNA. Cell 156, 935-949, doi:10.1016/j.cell.2014.02.001 (2014).
18 Peabody, D. S. The RNA binding site of bacteriophage MS2 coat protein. The EMBO journal 12, 595-600 (1993).
19 Auslander, S., Auslander, D., Muller, M., Wieland, M. & Fussenegger, M. Programmable single-cell mammalian biocomputers. Nature 487, 123-127, doi:10.1038/nature11149 (2012).
20 Lemon, B. & Tjian, R. Orchestrated response: a symphony of transcription factors for gene control. Genes & development 14, 2551-2569 (2000).
21 van Essen, D., Engist, B., Natoli, G. & Saccani, S. Two modes of transcriptional activation at native promoters by NF-kappaB p65. PLoS biology 7, e73, doi:10.1371/journal.pbio. 1000073 (2009).
22 Kretzschmar, M., Kaiser, K., Lottspeich, F. & Meisterernst, M. A novel mediator of class II gene transcription with homology to viral immediate-early transcriptional regulators. Cell 78, 525-534 (1994).
23 Ikeda, K., Stuehler, T. & Meisterernst, M. The H1 and H2 regions of the activation domain of herpes simplex virion protein 16 stimulate transcription through distinct 23 molecular mechanisms. Genes to cells: devoted to molecular & cellular mechanisms 7, 49-58 (2002).
24 Neely, K. E. et al. Activation domain-mediated targeting of the SWI/SNF complex to promoters stimulates transcription from nucleosome arrays. Molecular cell 4, 649-655 (1999).
25 Weintraub, H. et al. Muscle-specific transcriptional activation by MyoD. Genes & development 5, 1377-1386 (1991).
26 Cech, T. R. & Steitz, J. A. The noncoding RNA revolution-trashing old rules to forge new ones. Cell 157, 77-94, doi:10.1016/j.cell.2014.03.008 (2014).
27 Engreitz, J. M. et al. The Xist lncRNA exploits three-dimensional genome architecture to spread across the X chromosome. Science 341, 1237973, doi:10.1126/science.1237973 (2013).
28 Kretz, M. et al. Control of somatic tissue differentiation by the long non-coding RNA TINCR. Nature 493, 231-235, doi:10.1038/nature11661 (2013).
29 Wang, K. C. et al. A long noncoding RNA maintains active chromatin to coordinate homeotic gene expression. Nature 472, 120-124, doi:10.1038/nature09819 (2011).
30 Prensner, J. R. et al. Transcriptome sequencing across a prostate cancer cohort identifies PCAT-1, an unannotated lincRNA implicated in disease progression. Nature biotechnology 29, 742-749, doi:10.1038/nbt.1914 (2011).
31 Cabili, M. N. et al. Integrative annotation of human large intergenic noncoding RNAs reveals global properties and specific subclasses. Genes & development 25, 1915-1927, doi:10.1101/gad.17446611 (2011).
32 Li, J. et al. PTEN, a putative protein tyrosine phosphatase gene mutated in human brain, breast, and prostate cancer. Science 275, 1943-1947 (1997).
33 Bowman, T. et al. Stat3-mediated Myc expression is required for Src transformation and PDGF-induced mitogenesis. Proceedings of the National Academy of Sciences of the United States of America 98, 7319-7324, doi:10.1073/pnas.131568898 (2001).
34 Prahallad, A. et al. Unresponsiveness of colon cancer to BRAF(V600E) inhibition through feedback activation of EGFR. Nature 483, 100-103, doi:10.1038/nature10868 (2012).
35 Held, M. A. et al. Genotype-selective combination therapies for melanoma identified by high-throughput drug screening. Cancer discovery 3, 52-67, doi:10.1158/2159-8290.CD-12-0408 (2013).
36 Johannessen, C. M. et al. A melanocyte lineage program confers resistance to MAP kinase pathway inhibition. Nature 504, 138-142, doi:10.1038/nature12688 (2013).
37 Jenkins, L. et al. Agonist activation of the G protein-coupled receptor GPR35 involves transmembrane domain III and is transduced via Galpha(1)(3) and beta-arrestin-2. British journal of pharmacology 162, 733-748, doi:10.1111/j.1476-5381.2010.01082.x (2011).
38 Choi, J. W. et al. LPA receptors: subtypes and biological actions. Annual review of pharmacology and toxicology 50, 157-186, doi:10.1146/annurev.pharmtox.010909.105753 (2010).
39 Kumar, S. A. et al. Lysophosphatidic acid receptor expression in chronic lymphocytic leukemia leads to cell survival mediated though vascular endothelial growth factor expression. Leukemia & lymphoma 50, 2038-2048, doi:10.3109/10428190903275586 (2009).
40 Okabe, K. et al. Possible involvement of lysophosphatidic acid receptor-5 gene in the acquisition of growth advantage of rat tumor cells. Molecular carcinogenesis 50, 635-642, doi:10.1002/mc.20750 (2011).
41 Fujiwara, S. et al. Transforming activity of purinergic receptor P2Y, G protein coupled, 8 revealed by retroviral expression screening. Leukemia & lymphoma 48, 978-986, doi:10.1080/10428190701225882 (2007).
42 Johannessen, C. M. et al. COT drives resistance to RAF inhibition through MAP kinase pathway reactivation. Nature 468, 968-972, doi:10.1038/nature09627 (2010).
43 Gupta, S. K., Oommen, S., Aubry, M. C., Williams, B. P. & Vlahakis, N. E. Integrin alpha9beta1 promotes malignant tumor growth and metastasis by potentiating epithelial-mesenchymal transition. Oncogene 32, 141-150, doi:10.1038/onc.2012.41 (2013).
44 Bao, W. & Stromblad, S. Integrin alphav-mediated inactivation of p53 controls a MEK1-dependent melanoma cell survival pathway in three-dimensional collagen. The Journal of cell biology 167, 745-756, doi:10.1083/jcb.200404018 (2004).
45 Desgrosellier, J. S. & Cheresh, D. A. Integrins in cancer: biological implications and therapeutic opportunities. Nature reviews. Cancer 10, 9-22, doi:10.1038/nrc2748 (2010).
46 Seguin, L. et al. An integrin beta(3)-KRAS-Ra1B complex drives tumour stemness and resistance to EGFR inhibition. Nature cell biology 16, 457-468, doi:10.1038/ncb2953 (2014).
47 Konieczkowski, D. J. et al. A melanoma cell state distinction influences sensitivity to MAPK pathway inhibitors. Cancer discovery 4, 816-827, doi:10.1158/2159-8290.CD-13-0424 (2014).
48 Barretina, J. et al. The Cancer Cell Line Encyclopedia enables predictive modelling of anticancer drug sensitivity. Nature 483, 603-607, doi:10.1038/nature11003 (2012).
49 Lin, W. M. et al. Modeling genomic diversity and tumor dependency in malignant melanoma. Cancer research 68, 664-673, doi:10.1158/0008-5472.CAN-07-2615 (2008).
50 Wu, X. et al. Genome-wide binding of the CRISPR endonuclease Cas9 in mammalian cells. Nature biotechnology 32, 670-676, doi:10.1038/nbt.2889 (2014).
51 Luo, B. et al. Highly parallel identification of essential genes in cancer cells. Proceedings of the National Academy of Sciences of the United States of America 105, 20380-20385, doi:10.1073/pnas.0810485105 (2008).
52 Subramanian, A. et al. Gene set enrichment analysis: a knowledge-based approach for interpreting genome-wide expression profiles. Proceedings of the National Academy of Sciences of the United States of America 102, 15545-15550, doi:10.1073/pnas.0506580102 (2005).
53 Barbie, D. A. et al. Systematic RNA interference reveals that oncogenic KRAS-driven cancers require TBK1. Nature 462, 108-112, doi:10.1038/nature08460 (2009).
54 Liberzon, A. et al. Molecular signatures database (MSigDB) 3.0. Bioinformatics 27, 1739-1740, doi:10.1093/bioinformatics/btr260 (2011).

Example 21: Inducible Structural Design Activation Mediators Transgenic Mice

On the basis of Platt et al., Cell (2014), 159(2): 440-455, or PCT patent publications as herein cited, such as WO 2014/093622 (PCT/US2013/074667), an inducible structural design activation mediator transgenic mouse is established. A mouse engineered with the Lox-Stop-polyA-Lox (LSL) cassette upstream to the coding region of the SpCas9-VP64 fusion protein is established. A second mouse engineered with the Lox-Stop-polyA-Lox(LSL) cassette upstream to the coding region of the SpCas9-VP64 fusion Example 22: Screening for Gain of Function
Phenotypes Using Inducible Structural Design
Activation Mediators in Cells and Transgenic Mice The mice established in Example 21 are transfected with a AAV—Cre construct coding for and expressing Cre (such as under the control of a U6 promoter) and also coding for and expressing modified sgRNA (such as U6-modified sgRNA), according to the present invention via AAV. sgRNAs are designed to target the promoter region within 1000 nucleotides upstream of the TTS of lincRNAs of unknown function. Animals are screened for aberrant phenotypes.

Human guides and mouse guides of PCT application designating, inter alia, the United States, application No. PCT/US14/41806, filed Jun. 10, 2014, and the applications in the lineage of this PCT application (i.e., guides in the applications as to which PCT/US14/41806 claims priority), all incorporated herein by reference, are modified to contain an activator as herein discussed, or a repressor as herein discussed.

Human cells containing or modified to constitutively express or inducibly express Cas9 are transfected with an AAV construct coding for human sgRNA of PCT application designating, inter alia, the United States, application No. PCT/US14/41806, filed Jun. 10, 2014, and the applications in the lineage of this PCT application (i.e., guides in the applications as to which PCT/US14/41806 claims priority), wherein the guides include either at least one repressor or at least one activator, in accordance with the herein discussion, under the control of and operably linked to a promoter, such as U6-modified sgRNA, according to the present invention; and in the case of such cells wherein the Cas9 is inducibly expressed, Cre induces expression and the construct also via AAV codes for and expresses Cre, such as by way of coding therefor operably linked to a U6 promoter. The cells as to which the sgRNA has a activator are monitored for Gain of Function and the cells as to which the sgRNA has a repressor are monitored for Loss of Function. The cells as to which the modified sgRNA has an activator show gain of function, and the cells as to which the modified sgRNA has a repressor show loss of function. In this fashion, human cells can be screened.

The Cas9 mouse of Example 21, Platt et al., Cell (2014), 159(2): 440-455, or PCT publications as herein cited, such as WO 2014/093622 (PCT/US2013/074667), and are transfected with a AAV—Cre construct coding for and expressing Cre (such as under the control of a U6 promoter) and also coding for and expressing modified mouse sgRNA (such as U6-modified sgRNA) of PCT application designating, inter alia, the United States, application No. PCT/US14/41806, filed Jun. 10, 2014, and the applications in the lineage of this PCT application (i.e., guides in the applications as to which PCT/US14/41806 claims priority), wherein the guides include either at least one repressor or at least one activator, in accordance with the herein disclosure. The mice as to which the sgRNA has a activator are monitored for Gain of Function and the mice as to which the sgRNA has a repressor are monitored for Loss of Function. The mice as to which the modified sgRNA has an activator show gain of function, and the mice as to which the modified sgRNA has a repressor show loss of function. In this fashion, mice can be screened.

In an aspect, the vector systems in the methods of the invention comprise one or more lentiviral vector(s). In a preferred embodiment, the one or more lentiviral vectors may comprise a codon optimized nuclear localization signal (NLS), a codon optimized P2A bicistronic linker sequence and an optimally placed U6 driven guide RNA cassette. In another aspect the vector system comprises two lentiviral vectors, wherein one lentiviral vector comprises the Cas9 enzyme and the other lentiviral vector comprises the guide RNA selected from the libraries of the invention. In an embodiment of the invention, each vector has a different selection marker, e.g. a different antibiotic resistance marker. The invention also comprehends kits comprising the libraries of the invention. In certain aspects, the kit comprises a single container comprising vectors comprising the library of the invention. In other aspects, the kit comprises a single container comprising plasmids comprising the library of the invention. The invention also comprehends kits comprising a panel comprising a selection of unique CRISPR-Cas system guide sequences from the library of the invention, wherein the selection is indicative of a particular physiological condition. In preferred embodiments, the targeting is of about 100 or more sequences, about 1000 or more sequences or about 20,000 or more sequences or the entire genome. In other embodiments a panel of target sequences is focused on a relevant or desirable pathway, such as an immune pathway or cell division.

Example 23: Paired Nickase Fok1

Paired CRISPR-Cas complexes having a mutated CRISPR enzyme whereby the CRISPR enzyme is "dead" (has at most 5% nuclease activity of non-mutated Cas9 or CRISPR enzyme), and a Fok1 nuclease is operably linked to sgRNA are delivered to cells, whereby in the pair, a first CRISPR-Cas complex makes a cut at a first loci in the cells and a second CRISPR-Cas complex makes cut at a second loci in the cells; the two Fok1 enzymes provide a double stranded break such as when the first and second loci are at or near each other but on different strands of double stranded DNA, whereby such that the CRISPR-Cas complex(es) provide(s) a particular specific cut or double stranded cut, and the CRISPR-Cas complexes have a greater reduction in off-target cutting, than unmodified CRISPR-Cas complexes. The paired CRISPR-Cas9 complexes can cut the two strands of double stranded DNA such that HDR can occur. In embodiments template DNA is introduced into the cells whereby there is homologous recombination inserting the template DNA where the double stranded cut has been made.

Example 24: Three-Component Chimeric Cas9 Enzymes

Chimeric Cas9 enzymes were constructed and tested. The Chimeric enzymes had N' and C' terminal domains from Sp Cas9, but internal domains were swapped out for Sa or St3 domains to provide Sp-St3-Sp or Sp-Sa-Sp chimeric 3 component enzymes.

A range of guides were tested with each chimeric enzyme. The guides were either pure Sp, Sa or St3 wildtype, or they were engineered such that they were hybrids of Sp with Sa or St3. Where the enzyme included one or more St3 internal domains to form an Sp-St3-Sp chimeric 3-component enzyme, the hybrid guides comprised either: an Sp BackBone (BB) and an St3 Targeting Sequence (TGS); or an St3 BackBone (BB) and an Sp Targeting Sequence (TGS). Where one or more Sa internal domains were swapped in to form Sp-Sa-Sp chimeric 3-component enzyme, the guides were engineered to comprise either: an Sp BackBone (BB)

and an Sa Targeting Sequence (TGS); or an Sa BackBone (BB) and an Sp Targeting Sequence (TGS). The BackBone comprises the sgRNA scaffold (or tracr sequence and tracr mate) and the Targeting Sequence consisted of the 20 bp spacer portion of the sgRNA (specific for the DNA target).

The domains swapped in or out were not necessarily complete domains in that they included full and partial domains. While complete swap of the Rec lobe is within the ambit of the instant invention, for illustrative purposes, this work focused on partial swaps of the Rec lobe. The Nuc lobe comprises the RuvCI domain, the RuvCII domain, the HNH domain, RuvCIII domain and the PI domain, whilst the Rec lobe comprises the BH, REC1 and REC2 domains.

Methods

Cell Culture and Transfection

Human embryonic kidney (HEK) cell line 293FT (Life Technologies) or mouse Neuro 2a (Sigma-Aldrich) cell line was maintained in Dulbecco's modified Eagle's Medium (DMEM) supplemented with 10% fetal bovine serum (Hy-Clone), 2 mM GlutaMAX (Life Technologies), 100 U/mL penicillin, and 100 µg/mL streptomycin at 37° C. with 5% $CO_2$ incubation.

Cells were seeded onto 24-well plates (Corning) at a density of 120,000 cells/well, 24 hours prior to transfection. Cells were transfected using Lipofectamine 2000 (Life Technologies) at 80-90% confluency following the manufacturer's recommended protocol. A total of 500 ng Cas9 plasmid and 100 ng of U6-sgRNA PCR product was transfected.

SURVEYOR Nuclease Assay for Genome Modification

293FT and HUES62 cells were transfected with DNA as described above. Cells were incubated at 37° C. for 72 hours post-transfection prior to genomic DNA extraction. Genomic DNA was extracted using the QuickExtract DNA Extraction Solution (Epicentre) following the manufacturer's protocol. Briefly, pelleted cells were resuspended in QuickExtract solution and incubated at 65° C. for 15 minutes, 68° C. for 15 minutes, and 98° C. for 10 minutes.

The genomic region flanking the CRISPR target site for each gene was PCR amplified using primers as follows:

| primer name | genomic target | primer sequence (5' to 3') |
| --- | --- | --- |
| SUV901 | EMX1 | CCATCCCCTTCTGTGAATGT (SEQ ID NO: 143) |
| SUV902 | EMX1 | GGAGATTGGAGACACGGAGA (SEQ ID NO: 144) |

Products were purified using QiaQuick Spin Column (Qiagen) following the manufacturer's protocol. 400 ng total of the purified PCR products were mixed with 2 microliters 10×Taq DNA Polymerase PCR buffer (Enzymatics) and ultrapure water to a final volume of 20 microliters, and subjected to a re-annealing process to enable heteroduplex formation: 95° C. for 10 min, 95° C. to 85° C. ramping at −2° C./s, 85° C. to 25° C. at −0.25° C./s, and 25° C. hold for 1 minute. After re-annealing, products were treated with SURVEYOR nuclease and SURVEYOR enhancer S (Transgenomics) following the manufacturer's recommended protocol, and analyzed on 4-20% Novex TBE poly-acrylamide gels (Life Technologies). Gels were stained with SYBR Gold DNA stain (Life Technologies) for 30 minutes and imaged with a Gel Doc gel imaging system (Bio-rad).

Quantification was based on relative band intensities. Indel percentage was determined by the formula:

$$100 \times (1-(1-(b+c)/(a+b+c))^{1/2}),$$

where 'a' is the integrated intensity of the undigested PCR product, and 'b' and 'c' are the integrated intensities of each cleavage product.

Results

Figure 86:
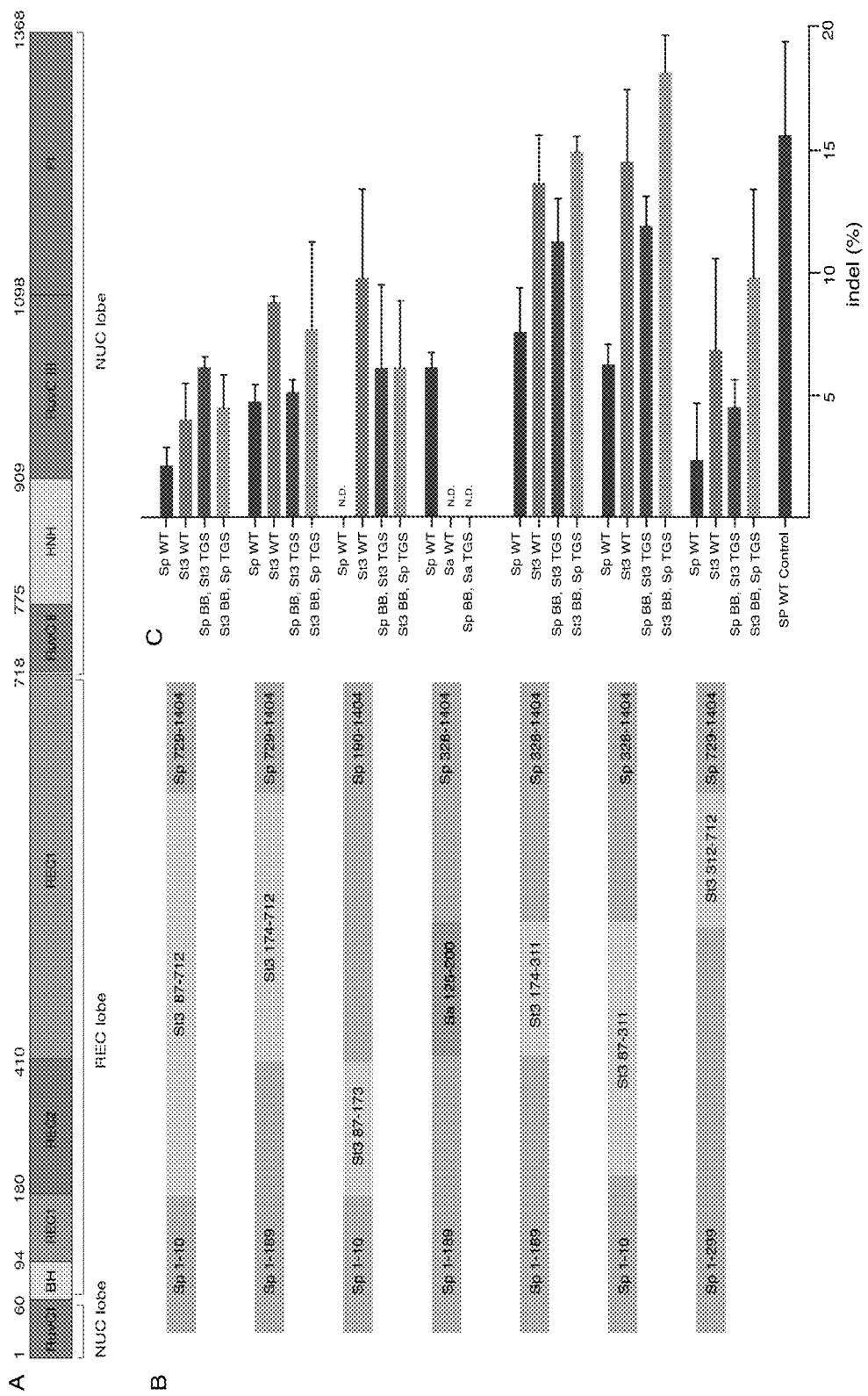
FIG. 86: shows testing of chimera between Sp, Sa and St3 Cas9 based on crystal structure. A) domain organization and amino acid (AA) positions of Sp Cas9. The REC lobe is a newly identified structural component of Cas9. B) Chimera maps of partial or complete swaps of the Nuc lobe, with AA positions of chimera boundaries indicated C) indel % achieved with each corresponding chimera on the left. Labels indicate the sgRNA used. TGS=targeting sequences (20 bp spacer portion of the sgRNA), BB=sgRNA backbone.

The helical domains, e.g., HD2 or Helical domain 2, discussed earlier herein, are initial annotations of the 1368 amino acid Sp Cas9 and current terminology also involves a Recognition or Rec lobe with three domains: REC1 (with reference to Sp Cas9 residues 94-179), REC2 (residues 180-307, with reference to Sp Cas9) and a long alpha helix referred to as the bridge helix (residues 60-93 with reference to Sp Cas9) (see Nishimasu et al). The results of this Example are shown in FIG. 86. FIG. 86 shows testing of chimera between Sp, Sa and St3 Cas9 based on crystal structure. A) domain organization and amino acid (AA) positions of Sp Cas9. The REC lobe is a newly identified structural component of Cas9. B) Chimera maps of partial or complete swaps of the Nuc lobe, with AA positions of chimera boundaries indicated C) indel % achieved with each corresponding chimera on the left. Labels indicate the sgRNA used. TGS=targeting sequences (20 bp spacer portion of the sgRNA), BB=sgRNA backbone Applicants found that it is possible to construct chimera between different Cas9 proteins (originating from different species) that consist of at least three components, thereby enabling internal domains to be swapped out. Applicants illustrated this with swaps performed on the internal REC lobe of Cas9, which was newly identified based on the crystal structure provided herein.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

REFERENCES

1. Urnov, F. D., Rebar, E. J., Holmes, M. C., Zhang, H. S. & Gregory, P. D. Genome editing with engineered zinc finger nucleases. *Nat. Rev. Genet.* 11, 636-646 (2010).
2. Bogdanove, A. J. & Voytas, D. F. TAL effectors: customizable proteins for DNA targeting. *Science* 333, 1843-1846 (2011).
3. Stoddard, B. L. Homing endonuclease structure and function. *Q. Rev. Biophys.* 38, 49-95 (2005).
4. Bae, T. & Schneewind, O. Allelic replacement in *Staphylococcus aureus* with inducible counter-selection. *Plasmid* 55, 58-63 (2006).
5. Sung, C. K., Li, H., Claverys, J. P. & Morrison, D. A. An rpsL cassette, janus, for gene replacement through negative selection in *Streptococcus pneumoniae*. *Appl. Environ. Microbiol.* 67, 5190-5196 (2001).
6. Sharan, S. K., Thomason, L. C., Kuznetsov, S. G. & Court, D. L. Recombineering: a homologous recombination-based method of genetic engineering. *Nat. Protoc.* 4, 206-223 (2009).

7. Jinek, M. et al. A programmable dual-RNA-guided DNA endonuclease in adaptive bacterial immunity. *Science* 337, 816-821 (2012).
8. Deveau, H., Garneau, J. E. & Moineau, S. CRISPR/Cas system and its role in phage-bacteria interactions. *Annu. Rev. Microbiol.* 64, 475-493 (2010).
9. Horvath, P. & Barrangou, R. CRISPR/Cas, the immune system of bacteria and archaea. *Science* 327, 167-170 (2010).
10. Terns, M. P. & Terns, R. M. CRISPR-based adaptive immune systems. *Curr. Opin. Microbiol.* 14, 321-327 (2011).
11. van der Oost, J., Jore, M. M., Westra, E. R., Lundgren, M. & Brouns, S. J. CRISPR-based adaptive and heritable immunity in prokaryotes. *Trends. Biochem. Sci.* 34, 401-407 (2009).
12. Brouns, S. J. et al. Small CRISPR RNAs guide antiviral defense in prokaryotes. *Science* 321, 960-964 (2008).
13. Carte, J., Wang, R., Li, H., Terns, R. M. & Terns, M. P. Cas6 is an endoribonuclease that generates guide RNAs for invader defense in prokaryotes. *Genes Dev.* 22, 3489-3496 (2008).
14. Deltcheva, E. et al. CRISPR RNA maturation by trans-encoded small RNA and host factor RNase III. *Nature* 471, 602-607 (2011).
15. Hatoum-Aslan, A., Maniv, I. & Marraffini, L. A. Mature clustered, regularly interspaced, short palindromic repeats RNA (crRNA) length is measured by a ruler mechanism anchored at the precursor processing site. *Proc. Natl. Acad. Sci. U.S.A.* 108, 21218-21222 (2011).
16. Haurwitz, R. E., Jinek, M., Wiedenheft, B., Zhou, K. & Doudna, J. A. Sequence- and structure-specific RNA processing by a CRISPR endonuclease. *Science* 329, 1355-1358 (2010).
17. Deveau, H. et al. Phage response to CRISPR-encoded resistance in *Streptococcus thermophilus*. *J. Bacteriol.* 190, 1390-1400 (2008).
18. Gasiunas, G., Barrangou, R., Horvath, P. & Siksnys, V. Cas9-crRNA ribonucleoprotein complex mediates specific DNA cleavage for adaptive immunity in bacteria. *Proc. Natl. Acad. Sci. U.S.A.* (2012).
19. Makarova, K. S., Aravind, L., Wolf, Y. I. & Koonin, E. V. Unification of Cas protein families and a simple scenario for the origin and evolution of CRISPR-Cas systems. *Biol. Direct.* 6, 38 (2011).
20. Barrangou, R. RNA-mediated programmable DNA cleavage. *Nat. Biotechnol.* 30, 836-838 (2012).
21. Brouns, S. J. Molecular biology. A Swiss army knife of immunity. *Science* 337, 808-809 (2012).
22. Carroll, D. A CRISPR Approach to Gene Targeting. *Mol. Ther.* 20, 1658-1660 (2012).
23. Bikard, D., Hatoum-Aslan, A., Mucida, D. & Marraffini, L. A. CRISPR interference can prevent natural transformation and virulence acquisition during in vivo bacterial infection. *Cell Host Microbe* 12, 177-186 (2012).
24. Sapranauskas, R. et al. The *Streptococcus thermophilus* CRISPR/Cas system provides immunity in *Escherichia coli*. *Nucleic Acids Res.* (2011).
25. Semenova, E. et al. Interference by clustered regularly interspaced short palindromic repeat (CRISPR) RNA is governed by a seed sequence. *Proc. Natl. Acad. Sci. U.S.A.* (2011).
26. Wiedenheft, B. et al. RNA-guided complex from a bacterial immune system enhances target recognition through seed sequence interactions. *Proc. Natl. Acad. Sci. U.S.A.* (2011).
27. Zahner, D. & Hakenbeck, R. The *Streptococcus pneumoniae* beta-galactosidase is a surface protein. *J. Bacteriol.* 182, 5919-5921 (2000).
28. Marraffini, L. A., Dedent, A. C. & Schneewind, O. Sortases and the art of anchoring proteins to the envelopes of gram-positive bacteria. *Microbiol. Mol. Biol. Rev.* 70, 192-221 (2006).
29. Motamedi, M. R., Szigety, S. K. & Rosenberg, S. M. Double-strand-break repair recombination in *Escherichia coli*: physical evidence for a DNA replication mechanism in vivo. *Genes Dev.* 13, 2889-2903 (1999).
30. Hosaka, T. et al. The novel mutation K87E in ribosomal protein S12 enhances protein synthesis activity during the late growth phase in *Escherichia coli*. *Mol. Genet. Genomics* 271, 317-324 (2004).
31. Costantino, N. & Court, D. L. Enhanced levels of lambda Red-mediated recombinants in mismatch repair mutants. *Proc. Natl. Acad. Sci. U.S.A.* 100, 15748-15753 (2003).
32. Edgar, R. & Qimron, U. The *Escherichia coli* CRISPR system protects from lambda lysogenization, lysogens, and prophage induction. *J. Bacteriol.* 192, 6291-6294 (2010).
33. Marraffini, L. A. & Sontheimer, E. J. Self versus non-self discrimination during CRISPR RNA-directed immunity. *Nature* 463, 568-571 (2010).
34. Fischer, S. et al. An archaeal immune system can detect multiple Protospacer Adjacent Motifs (PAMs) to target invader DNA. *J. Biol. Chem.* 287, 33351-33363 (2012).
35. Gudbergsdottir, S. et al. Dynamic properties of the *Sulfolobus* CRISPR/Cas and CRISPR/Cmr systems when challenged with vector-borne viral and plasmid genes and protospacers. *Mol. Microbiol.* 79, 35-49 (2011).
36. Wang, H. H. et al. Genome-scale promoter engineering by coselection MAGE. *Nat Methods* 9, 591-593 (2012).
37. Cong L, Ran F A, Cox D, Lin S, Barretto R, Habib N, Hsu P D, Wu X, Jiang W, Marraffini L A, Zhang F. Multiplex Genome Engineering Using CRISPR/Cas Systems. *Science*. 2013 Feb. 15; 339(6121):819-23.
38. Mali, P., Yang, L., Esvelt, K. M., Aach, J., Guell, M., DiCarlo, J. E., Norville, J. E., and Church, G. M. (2013b). RNA-guided human genome engineering via Cas9. *Science* 339, 823-826.
39. Hoskins, J. et al. Genome of the bacterium *Streptococcus pneumoniae* strain R6. *J. Bacteriol.* 183, 5709-5717 (2001).
40. Havarstein, L. S., Coomaraswamy, G. & Morrison, D. A. An unmodified heptadecapeptide pheromone induces competence for genetic transformation in *Streptococcus pneumoniae*. *Proc. Natl. Acad. Sci. U.S.A.* 92, 11140-11144 (1995).
41. Horinouchi, S. & Weisblum, B. Nucleotide sequence and functional map of pC194, a plasmid that specifies inducible chloramphenicol resistance. *J. Bacteriol.* 150, 815-825 (1982).
42. Horton, R. M. In Vitro Recombination and Mutagenesis of DNA: SOEing Together Tailor-Made Genes. *Methods Mol. Biol.* 15, 251-261 (1993).
43. Podbielski, A., Spellerberg, B., Woischnik, M., Pohl, B. & Lutticken, R. Novel series of plasmid vectors for gene inactivation and expression analysis in group A streptococci (GAS). *Gene* 177, 137-147 (1996).
44. Husmann, L. K., Scott, J. R., Lindahl, G. & Stenberg, L. Expression of the Arp protein, a member of the M protein family, is not sufficient to inhibit phagocytosis of *Streptococcus pyogenes*. *Infection and immunity* 63, 345-348 (1995).

45. Gibson, D. G. et al. Enzymatic assembly of DNA molecules up to several hundred kilobases. *Nat Methods* 6, 343-345 (2009).
46. Garneau J. E. et al. The CRISPR/Cas bacterial immune system cleaves bacteriophage and plasmid DNA. Nature 468, 67-71(4 Nov. 2010)
47. Barrangou R. et al. CRISPR provides acquired resistance against viruses in prokaryotes. Science. 2007 Mar. 23; 315(5819):1709-12.
48. Ishino Y. et al. Nucleotide sequence of the iap gene, responsible for alkaline phosphatase isozyme conversion in *Escherichia coli*, and identification of the gene product. J Bacteriol. 1987 December; 169(12):5429-33.
49. Mojica F. J. M et al. Biological significance of a family of regularly spaced repeats in the genomes of Archaea, Bacteria and mitochondria. Molecular Microbiology (2000) 36(1), 244-246.
50. Jansen R. et al. Identification of genes that are associated with DNA repeats in prokaryotes. Molecular Microbiology (2002) 43(6), 1565-1575.
51. Gouet, P., Courcelle, E., Stuart, D. I., and Metoz, F. (1999). ESPript: analysis of multiple sequence alignments in PostScript. Bioinformatics 15, 305-308.
52. Notredame, C., Higgins, D. G., and Heringa, J. (2000). T-Coffee: A novel method for fast and accurate multiple sequence alignment. J Mol Biol 302, 205-217.
53. Adams, P. D., Grosse-Kunstleve, R. W., Hung, L. W., Ioerger, T. R., McCoy, A. J., Moriarty, N. W., Read, R. J., Sacchettini, J. C., Sauter, N. K., and Terwilliger, T. C. (2002). PHENIX: building new software for automated crystallographic structure determination. Acta Crystallogr D Biol Crystallogr 58, 1948-1954.
54. Ariyoshi, M., Vassylyev, D. G., Iwasaki, H., Nakamura, H., Shinagawa, H., and Morikawa, K. (1994). Atomic structure of the RuvC resolvase: a holliday junction-specific endonuclease from *E. coli*. Cell 78, 1063-1072.
55. Biertumpfel, C., Yang, W., and Suck, D. (2007). Crystal structure of T4 endonuclease VII resolving a Holliday junction. Nature 449, 616-620.
56. Chen, L., Shi, K., Yin, Z., and Aihara, H. (2013). Structural asymmetry in the *Thermus thermophilus* RuvC dimer suggests a basis for sequential strand cleavages during Holliday junction resolution. Nucleic acids research 41, 648-656.
57. delaFortelle, E., and Bricogne, G. (1997). Maximum-likelihood heavy-atom parameter refinement for multiple isomorphous replacement and multiwavelength anomalous diffraction methods. Methods Enzymol 276, 472-494.
58. Emsley, P., and Cowtan, K. (2004). Coot: model-building tools for molecular graphics. Acta Crystallogr D Biol Crystallogr 60, 2126-2132.
59. Fonfara, I., Le Rhun, A., Chylinski, K., Makarova, K. S., Lecrivain, A. L., Bzdrenga, J., Koonin, E. V., and Charpentier, E. (2013). Phylogeny of Cas9 determines functional exchangeability of dual-RNA and Cas9 among orthologous type II CRISPR-Cas systems. Nucleic acids research.
60. Fu, Y., Foden, J. A., Khayter, C., Maeder, M. L., Reyon, D., Joung, J. K., and Sander, J. D. (2013). High-frequency off-target mutagenesis induced by CRISPR-Cas nucleases in human cells. Nature biotechnology 31, 822-826.
61. Gilbert, L. A., Larson, M. H., Morsut, L., Liu, Z., Brar, G. A., Tones, S. E., Stern-Ginossar, N., Brandman, O., Whitehead, E. H., Doudna, J. A., et al. (2013). CRISPR-mediated modular RNA-guided regulation of transcription in eukaryotes. Cell 154, 442-451.
62. Gorecka, K. M., Komorowska, W., and Nowotny, M. (2013). Crystal structure of RuvC resolvase in complex with Holliday junction substrate. Nucleic Acids Res 41, 9945-9955.
63. Gratz, S. J., Cummings, A. M., Nguyen, J. N., Hamm, D. C., Donohue, L. K., Harrison, M. M., Wildonger, J., and O'Connor-Giles, K. M. (2013). Genome engineering of *Drosophila* with the CRISPR RNA-guided Cas9 nuclease. Genetics 194, 1029-1035.
64. Holm, L., and Rosenstrom, P. (2010). Dali server: conservation mapping in 3D. Nucleic acids research 38, W545-549.
65. Hsu, P. D., Scott, D. A., Weinstein, J. A., Ran, F. A., Konermann, S., Agarwala, V., Li, Y., Fine, E. J., Wu, X., Shalem, O., et al. (2013). DNA targeting specificity of RNA-guided Cas9 nucleases. Nature biotechnology 31, 827-832.
66. Hwang, W. Y., Fu, Y., Reyon, D., Maeder, M. L., Tsai, S. Q., Sander, J. D., Peterson, R. T., Yeh, J. R., and Joung, J. K. (2013). Efficient genome editing in zebrafish using a CRISPR-Cas system. Nature biotechnology 31, 227-229.
67. Kabsch, W. (2010). Xds. Acta crystallographica Section D, Biological crystallography 66, 125-132.
68. Konermann, S., Brigham, M. D., Trevino, A. E., Hsu, P. D., Heidenreich, M., Cong, L., Platt, R. J., Scott, D. A., Church, G. M., and Zhang, F. (2013). Optical control of mammalian endogenous transcription and epigenetic states. Nature 500, 472-476.
69. Li, C. L., Hor, L. I., Chang, Z. F., Tsai, L. C., Yang, W. Z., and Yuan, H. S. (2003). DNA binding and cleavage by the periplasmic nuclease Vvn: a novel structure with a known active site. The EMBO journal 22, 4014-4025.
70. Maeder, M. L., Linder, S. J., Cascio, V. M., Fu, Y., Ho, Q. H., and Joung, J. K. (2013). CRISPR RNA-guided activation of endogenous human genes. Nature methods 10, 977-979.
71. Mali, P., Aach, J., Stranges, P. B., Esvelt, K. M., Moosburner, M., Kosuri, S., Yang, L., and Church, G. M. (2013a). CAS9 transcriptional activators for target specificity screening and paired nickases for cooperative genome engineering. Nature biotechnology 31, 833-838.
72. Marraffini, L. A., and Sontheimer, E. J. (2008). CRISPR interference limits horizontal gene transfer in staphylococci by targeting DNA. Science 322, 1843-1845.
73. Marraffini, L. A., and Sontheimer, E. J. (2010). CRISPR interference: RNA-directed adaptive immunity in bacteria and archaea. Nat Rev Genet 11, 181-190.
74. Mojica, F. J., Diez-Villasenor, C., Garcia-Martinez, J., and Almendros, C. (2009). Short motif sequences determine the targets of the prokaryotic CRISPR defence system. Microbiology 155, 733-740.
75. Pattanayak, V., Lin, S., Guilinger, J. P., Ma, E., Doudna, J. A., and Liu, D. R. (2013). High-throughput profiling of off-target DNA cleavage reveals RNA-programmed Cas9 nuclease specificity. Nature biotechnology 31, 839-843.
76. Perez-Pinera, P., Kocak, D. D., Vockley, C. M., Adler, A. F., Kabadi, A. M., Polstein, L. R., Thakore, P. I., Glass, K. A., Ousterout, D. G., Leong, K. W., et al. (2013). RNA-guided gene activation by CRISPR-Cas9-based transcription factors. Nature methods 10, 973-976.
77. Qi, L. S., Larson, M. H., Gilbert, L. A., Doudna, J. A., Weissman, J. S., Arkin, A. P., and Lim, W. A. (2013). Repurposing CRISPR as an RNA-guided platform for sequence-specific control of gene expression. Cell 152, 1173-1183.

78. Ran, F. A., Hsu, P. D., Lin, C. Y., Gootenberg, J. S., Konermann, S., Trevino, A. E., Scott, D. A., Inoue, A., Matoba, S., Zhang, Y., et al. (2013). Double nicking by RNA-guided CRISPR Cas9 for enhanced genome editing specificity. Cell 154, 1380-1389.
79. Sampson, T. R., Saroj, S. D., Llewellyn, A. C., Tzeng, Y. L., and Weiss, D. S. (2013). A CRISPR/Cas system mediates bacterial innate immune evasion and virulence. Nature 497, 254-257.
80. Shalem, O., Sanjana, N. E., Hartenian, E., Shi, X., Scott, D. A., Mikkelsen, T. S., Heckl, D., Ebert, B. L., Root, D. E., Doench, J. G., et al. (2014). Genome-scale CRISPR-Cas9 knockout screening in human cells. Science 343, 84-87.
81. Sheldrick, G. M. (2008). A short history of SHELX Acta crystallographica Section A, Foundations of crystallography 64, 112-122.
82. Spilman, M., Cocozaki, A., Hale, C., Shao, Y., Ramia, N., Terns, R., Terns, M., Li, H., and Stagg, S. (2013). Structure of an RNA silencing complex of the CRISPR-Cas immune system. Molecular cell 52, 146-152.
83. Wang, H., Yang, H., Shivalila, C. S., Dawlaty, M. M., Cheng, A. W., Zhang, F., and Jaenisch, R. (2013). One-step generation of mice carrying mutations in multiple genes by CRISPR/Cas-mediated genome engineering. Cell 153, 910-918.
84. Wang, T., Wei, J. J., Sabatini, D. M., and Lander, E. S. (2014). Genetic screens in human cells using the CRISPR-Cas9 system. Science 343, 80-84.
85. Wiedenheft, B., Lander, G. C., Zhou, K., Jore, M. M., Brouns, S. J., van der Oost, J., Doudna, J. A., and Nogales, E. (2011). Structures of the RNA-guided surveillance complex from a bacterial immune system. Nature 477, 486-489.
86. Winn, M. D., Ballard, C. C., Cowtan, K. D., Dodson, E. J., Emsley, P., Evans, P. R., Keegan, R. M., Krissinel, E. B., Leslie, A. G., McCoy, A., et al. (2011). Overview of the CCP4 suite and current developments. Acta crystallographica Section D, Biological crystallography 67, 235-242.
87. Yang, H., Wang, H., Shivalila, C. S., Cheng, A. W., Shi, L., and Jaenisch, R. (2013). One-step generation of mice carrying reporter and conditional alleles by CRISPR/Cas-mediated genome engineering. Cell 154, 1370-1379.

LENGTHY TABLES

The patent contains a lengthy table section. A copy of the table is available in electronic form from the USPTO web site (http://seqdata.uspto.gov/?pageRequest=docDetail&DocID=US10550372B2). An electronic copy of the table will also be available from the USPTO upon request and payment of the fee set forth in 37 CFR 1.19(b)(3).

SEQUENCE LISTING (636 sequences)

SEQ ID NO: 1 - protein, 4 aa, Artificial Sequence
  source: /note="Description of Artificial Sequence: Synthetic peptide"
GGGS

SEQ ID NO: 2 - protein, 7 aa, Artificial Sequence
  source: /note="Description of Artificial Sequence: Synthetic peptide"
AEAAAKA

SEQ ID NO: 3 - protein, 17 aa, Artificial Sequence
  source: /note="Description of Artificial Sequence: Synthetic peptide"
AEAAAKEAAAKEAAAKA

SEQ ID NO: 4 - protein, 32 aa, Artificial Sequence
  source: /note="Description of Artificial Sequence: Synthetic polypeptide"
AEAAAKEAAAKEAAAKEAAAKEAAAKEAAAKA

SEQ ID NO: 5 - protein, 47 aa, Artificial Sequence
  source: /note="Description of Artificial Sequence: Synthetic polypeptide"
AEAAAKEAAAKEAAAKEAAAKEAAAKEAAAKEAAAKEAAAKEAAAKA

SEQ ID NO: 6 - protein, 62 aa, Artificial Sequence
  source: /note="Description of Artificial Sequence: Synthetic polypeptide"
AEAAAKEAAAKEAAAKEAAAKEAAAKEAAAKEAAAKEAAAKEAAAKEAAAKEAAAKEAAAKA

SEQ ID NO: 7 - protein, 6 aa, Artificial Sequence
  source: /note="Description of Artificial Sequence: Synthetic peptide"
AEAAAK

SEQ ID NO: 8 - DNA, 34 bp, Artificial Sequence
  source: /note="Description of Artificial Sequence: Synthetic oligonucleotide"
ggccaacatgaggatcacccatgtctgcagggcc

SEQ ID NO: 9 - protein, 15 aa, Artificial Sequence
  source: /note="Description of Artificial Sequence: Synthetic peptide"
GGGGSGGGGSGGGGS

SEQ ID NO: 10 - protein, 30 aa, Artificial Sequence
  source: /note="Description of Artificial Sequence: Synthetic polypeptide"
GGGGSGGGGSGGGGSGGGGSGGGGSGGGGS

SEQ ID NO: 11 - protein, 45 aa, Artificial Sequence
  source: /note="Description of Artificial Sequence: Synthetic polypeptide"
GGGGSGGGGSGGGGSGGGGSGGGGSGGGGSGGGGSGGGGSGGGGS

SEQ ID NO: 12 - protein, 60 aa, Artificial Sequence
  source: /note="Description of Artificial Sequence: Synthetic polypeptide"
GGGGSGGGGSGGGGSGGGGSGGGGSGGGGSGGGGSGGGGSGGGGSGGGGSGGGGSGGGGS

SEQ ID NO: 13 - protein, 12 aa, Artificial Sequence
  source: /note="Description of Artificial Sequence: Synthetic peptide"
GGGSGGGSGGGS

SEQ ID NO: 14 - protein, 5 aa, Artificial Sequence
  source: /note="Description of Artificial Sequence: Synthetic peptide"
GGGGS

SEQ ID NO: 15 - RNA, 12 nt, Artificial Sequence
  source: /note="Description of Artificial Sequence: Synthetic oligonucleotide"
gcuagaauagca

SEQ ID NO: 16 - RNA, 14 nt, Artificial Sequence
  source: /note="Description of Artificial Sequence: Synthetic oligonucleotide"
aacuugaaaaagug

SEQ ID NO: 17 - protein, 4 aa, Artificial Sequence
  source: /note="Description of Artificial Sequence: Synthetic peptide"
GGSG

SEQ ID NO: 18 - DNA, 23 bp, Artificial Sequence
  source: /note="Description of Artificial Sequence: Synthetic oligonucleotide"
  modified_base (1)..(20): a, c, t or g
  modified_base (21)..(21): a, c, t, g, unknown or other
nnnnnnnnnnnnnnnnnnnnngg

SEQ ID NO: 19 - DNA, 15 bp, Artificial Sequence
  source: /note="Description of Artificial Sequence: Synthetic oligonucleotide"
  modified_base (1)..(12): a, c, t or g
  modified_base (13)..(13): a, c, t, g, unknown or other
nnnnnnnnnnnnngg

SEQ ID NO: 20 - DNA, 23 bp, Artificial Sequence
  source: /note="Description of Artificial Sequence: Synthetic oligonucleotide"
  modified_base (1)..(20): a, c, t or g
  modified_base (21)..(21): a, c, t, g, unknown or other
nnnnnnnnnnnnnnnnnnnnngg

SEQ ID NO: 21 - DNA, 14 bp, Artificial Sequence
  source: /note="Description of Artificial Sequence: Synthetic oligonucleotide"
  modified_base (1)..(11): a, c, t or g
  modified_base (12)..(12): a, c, t, g, unknown or other
nnnnnnnnnnnngg

SEQ ID NO: 22 - DNA, 27 bp, Artificial Sequence
  source: /note="Description of Artificial Sequence: Synthetic oligonucleotide"
  modified_base (1)..(20): a, c, t or g
  modified_base (21)..(22): a, c, t, g, unknown or other
nnnnnnnnnnnnnnnnnnnnnnagaaw

SEQ ID NO: 23 - DNA, 19 bp, Artificial Sequence
  source: /note="Description of Artificial Sequence: Synthetic oligonucleotide"
  modified_base (1)..(12): a, c, t or g
  modified_base (13)..(14): a, c, t, g, unknown or other
nnnnnnnnnnnnnnagaaw

SEQ ID NO: 24 - DNA, 27 bp, Artificial Sequence
  source: /note="Description of Artificial Sequence: Synthetic oligonucleotide"
  modified_base (1)..(20): a, c, t or g
  modified_base (21)..(22): a, c, t, g, unknown or other
nnnnnnnnnnnnnnnnnnnnnnagaaw

SEQ ID NO: 25 - DNA, 18 bp, Artificial Sequence
  source: /note="Description of Artificial Sequence: Synthetic oligonucleotide"
  modified_base (1)..(11): a, c, t or g
  modified_base (12)..(13): a, c, t, g, unknown or other
nnnnnnnnnnnnnagaaw

SEQ ID NO: 26 - DNA, 25 bp, Artificial Sequence
  source: /note="Description of Artificial Sequence: Synthetic oligonucleotide"
  modified_base (1)..(20): a, c, t or g
  modified_base (21)..(21): a, c, t, g, unknown or other
  modified_base (24)..(24): a, c, t, g, unknown or other
nnnnnnnnnnnnnnnnnnnnnggng

SEQ ID NO: 27 - DNA, 17 bp, Artificial Sequence
  source: /note="Description of Artificial Sequence: Synthetic oligonucleotide"
  modified_base (1)..(12): a, c, t or g
  modified_base (13)..(13): a, c, t, g, unknown or other
  modified_base (16)..(16): a, c, t, g, unknown or other
nnnnnnnnnnnnnggng

SEQ ID NO: 28 - DNA, 25 bp, Artificial Sequence
  source: /note="Description of Artificial Sequence: Synthetic oligonucleotide"
  modified_base (1)..(20): a, c, t or g
  modified_base (21)..(21): a, c, t, g, unknown or other
  modified_base (24)..(24): a, c, t, g, unknown or other
nnnnnnnnnnnnnnnnnnnnnggng

SEQ ID NO: 29 - DNA, 16 bp, Artificial Sequence
  source: /note="Description of Artificial Sequence: Synthetic oligonucleotide"
  modified_base (1)..(11): a, c, t or g
  modified_base (12)..(12): a, c, t, g, unknown or other
  modified_base (15)..(15): a, c, t, g, unknown or other
nnnnnnnnnnnnggng

SEQ ID NO: 30 - DNA, 137 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngtttttgtactctcaagatttagaaataaatcttgcagaagctacaaagataaggcttcatgccgaaatcaacaccctgtcattttatggcagggtgttttcgttatttaatttttt

SEQ ID NO: 31 - DNA, 123 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngtttttgtactctcagaaatgcagaagctacaaagataaggcttcatgccgaaatcaacaccctgtcattttatggcagggtgttttcgttatttaatttttt

SEQ ID NO: 32 - DNA, 110 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngtttttgtactctcagaaatgcagaagctacaaagataaggcttcatgccgaaatcaacaccctgtcattttatggcagggtgttttttt

SEQ ID NO: 33 - DNA, 102 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngttttagagctagaaatagcaagttaaaataaggctagtccgttatcaacttgaaaaagtggcaccgagtcggtgctttttt

SEQ ID NO: 34 - DNA, 88 bp, Artificial Sequence
  source: /note="Description of Artificial Sequence: Synthetic oligonucleotide"
  modified_base (1)..(20): a, c, t, g, unknown or other
nnnnnnnnnnnnnnnnnnnngttttagagctagaaatagcaagttaaaataaggctagtccgttatcaacttgaaaaagtgttttttt

SEQ ID NO: 35 - DNA, 76 bp, Artificial Sequence
  source: /note="Description of Artificial Sequence: Synthetic oligonucleotide"
  modified_base (1)..(20): a, c, t, g, unknown or other
nnnnnnnnnnnnnnnnnnnngttttagagctagaaatagcaagttaaaataaggctagtccgttatcatttttttt

SEQ ID NO: 36 - DNA, 20 bp, Homo sapiens
gagtccgagcagaagaagaa

SEQ ID NO: 37 - DNA, 20 bp, Homo sapiens
gagtcctagcaggagaagaa

SEQ ID NO: 38 - DNA, 20 bp, Homo sapiens
gagtctaagcagaagaagaa

SEQ ID NO: 39 - DNA, 12 bp, Artificial Sequence
  source: /note="Description of Artificial Sequence: Synthetic oligonucleotide"
gttttagagcta

SEQ ID NO: 40 - DNA, 31 bp, Artificial Sequence
  source: /note="Description of Artificial Sequence: Synthetic oligonucleotide"
tagcaagttaaaataaggctagtccgttttt

SEQ ID NO: 41 - RNA, 12 nt, Artificial Sequence
  source: /note="Description of Artificial Sequence: Synthetic oligonucleotide"
guuuuagagcua

SEQ ID NO: 42 - DNA, 33 bp, Artificial Sequence
  source: /note="Description of Artificial Sequence: Synthetic oligonucleotide"
ggacatcgatgtcacctccaatgactagggtgg

SEQ ID NO: 43 - DNA, 33 bp, Artificial Sequence
  source: /note="Description of Artificial Sequence: Synthetic oligonucleotide"
cattggaggtgacatcgatgtcctccccattgg

SEQ ID NO: 44 - DNA, 33 bp, Artificial Sequence
  source: /note="Description of Artificial Sequence: Synthetic oligonucleotide"
ggaagggcctgagtccgagcagaagaagaaggg

SEQ ID NO: 45 - DNA, 33 bp, Artificial Sequence
  source: /note="Description of Artificial Sequence: Synthetic oligonucleotide"
ggtggcgagaggggccgagattgggtgttcagg

SEQ ID NO: 46 - DNA, 33 bp, Artificial Sequence
  source: /note="Description of Artificial Sequence: Synthetic oligonucleotide"
atgcaggagggtggcgagaggggccgagattgg

SEQ ID NO: 47 - DNA, 4677 bp, Artificial Sequence
  source: /note="Description of Artificial Sequence: Synthetic polynucleotide"
tctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacatgtacccatacgatgttccagattacgcttcgccgaagaaaaagcgcaaggtcgaagcgtccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagccccaagaagaagagaaaggtggaggccagctaaggatccggcaagactggccccgcttggcaacgcaacagtgagcccctccctagtgtgtttggggatgtgactatgtattcgtgtgttggccaacgggtcaacccgaacagattgatacccgccttggcatttcctgtcagaatgtaacgtcagttgatggtact

SEQ ID NO: 48 - DNA, 3150 bp, Artificial Sequence
  source: /note="Description of Artificial Sequence: Synthetic polynucleotide"
tctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacatgcctaagaagaagaggaaggttaacacgattaacatcgctaagaacgacttctctgacatcgaactggctgctatcccgttcaacactctggctgaccattacggtgagcgtttagctcgcgaacagttggcccttgagcatgagtcttacgagatgggtgaagcacgcttccgcaagatgtttgagcgtcaacttaaagctggtgaggttgcggataacgctgccgccaagcctctcatcactaccctactccctaagatgattgcacgcatcaacgactggtttgaggaagtgaaagctaagcgcggcaagcgcccgacagccttccagttcctgcaagaaatcaagccggaagccgtagcgtacatcaccattaagaccactctggcttgcctaaccagtgctgacaatacaaccgttcaggctgtagcaagcgcaatcggtcgggccattgaggacgaggctcgcttcggtcgtatccgtgaccttgaagctaagcacttcaagaaaaacgttgaggaacaactcaacaagcgcgtagggcacgtctacaagaaagcatttatgcaagttgtcgaggctgacatgctctctaagggtctactcggtggcgaggcgtggtcttcgtggcataaggaagactctattcatgtaggagtacgctgcatcgagatgctcattgagtcaaccggaatggttagcttacaccgccaaaatgctggcgtagtaggtcaagactctgagactatcgaactcgcacctgaatacgctgaggctatcgcaacccgtgcaggtgcgctggctggcatctctccgatgttccaaccttgcgtagttcctcctaagccgtggactggcattactggtggtggctattgggctaacggtcgtcgtcctctggcgctggtgcgtactcacagtaagaaagcactgatgcgctacgaagacgtttacatgcctgaggtgtacaaagcgattaacattgcgcaaaacaccgcatggaaaatcaacaagaaagtcctagcggtcgccaacgtaatcaccaagtggaagcattgtccggtcgaggacatccctgcgattgagcgtgaagaactcccgatgaaaccggaagacatcgacatgaatcctgaggctctcaccgcgtggaaacgtgctgccgctgctgtgtaccgcaaggacaaggctcgcaagtctcgccgtatcagccttgagttcatgcttgagcaagccaataagtttgctaaccataaggccatctggttcccttacaacatggactggcgcggtcgtgtttacgctgtgtcaatgttcaacccgcaaggtaacgatatgaccaaaggactgcttacgctggcgaaaggtaaaccaatcggtaaggaaggttactactggctgaaaatccacggtgcaaactgtgcgggtgtcgacaaggttccgttccctgagcgcatcaagttcattgaggaaaaccacgagaacatcatggcttgcgctaagtctccactggagaacacttggtgggctgagcaagattctccgttctgcttccttgcgttctgctttgagtacgctggggtacagcaccacggcctgagctataactgctcccttccgctggcgtttgacgggtcttgctctggcatccagcacttctccgcgatgctccgagatgaggtaggtggtcgcgcggttaacttgcttcctagtgaaaccgttcaggacatctacgggattgttgctaagaaagtcaacgagattctacaagcagacgcaatcaatgggaccgataacgaagtagttaccgtgaccgatgagaacactggtgaaatctctgagaaagtcaagctgggcactaaggcactggctggtcaatggctggcttacggtgttactcgcagtgtgactaagcgttcagtcatgacgctggcttacgggtccaaagagttcggcttccgtcaacaagtgctggaagataccattcagccagctattgattccggcaagggtctgatgttcactcagccgaatcaggctgctggatacatggctaagctgatttgggaatctgtgagcgtgacggtggtagctgcggttgaagcaatgaactggcttaagtctgctgctaagctgctggctgctgaggtcaaagataagaagactggagagattcttcgcaagcgttgcgctgtgcattgggtaactcctgatggtttccctgtgtggcaggaatacaagaagcctattcagacgcgcttgaacctgatgttcctcggtcagttccgcttacagcctaccattaacaccaacaaagatagcgagattgatgcacacaaacaggagtctggtatcgctcctaactttgtacacagccaagacggtagccaccttcgtaagactgtagtgtgggcacacgagaagtacggaatcgaatcttttgcactgattcacgactccttcggtacgattccggctgacgctgcgaacctgttcaaagcagtgcgcgaaactatggttgacacatatgagtcttgtgatgtactggctgatttctacgaccagttcgctgaccagttgcacgagtctcaattggacaaaatgccagcacttccggctaaaggtaacttgaacctccgtgacatcttagagtcggacttcgcgttcgcgtaaggatccggcaagactggccccgcttggcaacgcaacagtgagcccctccctagtgtgtttggggatgtgactatgtattcgtgtgttggccaacgggtcaacccgaacagattgatacccgccttggcatttcctgtcagaatgtaacgtcagttgatggtact

SEQ ID NO: 49 - DNA, 125 bp, Artificial Sequence
  source: /note="Description of Artificial Sequence: Synthetic polynucleotide"
  modified_base (23)..(42): a, c, t, g, unknown or other
gaaattaatacgactcactatannnnnnnnnnnnnnnnnnnngttttagagctagaaatagcaagttaaaataaggctagtccgttatcaacttgaaaaagtggcaccgagtcggtgcttttttt

SEQ ID NO: 50 - DNA, 8452 bp, Artificial Sequence
  source: /note="Description of Artificial Sequence: Synthetic polynucleotide"
tgcggtatttcacaccgcatcaggtggcacttttcggggaaatgtgcgcggaacccctatttgtttatttttctaaatacattcaaatatgtatccgctcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgttgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggtcgctgaggcttgacatgattggtgcgtatgtttgtatgaagctacaggactgatttggcgggctatgagggcgggggaagctctggaagggccgcgatggggcgcgcggcgtccagaaggcgccatacggcccgctggcggcacccatccggtataaaagcccgcgaccccgaacggtgacctccactttcagcgacaaacgagcacttatacatacgcgactattctgccgctatacataaccactcagctagcttaagatcccatcaagcttgcatgccgggcgcgccagaaggagcgcagccaaaccaggatgatgtttgatggggtatttgagcacttgcaacccttatccggaagccccctggcccacaaaggctaggcgccaatgcaagcagttcgcatgcagcccctggagcggtgccctcctgataaaccggccagggggcctatgttctttacttttttacaagagaagtcactcaacatcttaaaatggccaggtgagtcgacgagcaagcccggcggatcaggcagcgtgcttgcagatttgacttgcaacgcccgcattgtgtcgacgaaggcttttggctcctctgtcgctgtctcaagcagcatctaaccctgcgtcgccgtttccatttgcaggagattcgaggtaccatgtacccatacgatgttccagattacgcttcgccgaagaaaaagcgcaaggtcgaagcgtccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagccccaagaagaagagaaaggtggaggccagctaacatatgattcgaatgtctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacatgacacaagaatccctgttacttctcgaccgtattgattcggatgattcctacgcgagcctgcggaacgaccaggaattctgggaggtgagtcgacgagcaagcccggcggatcaggcagcgtgcttgcagatttgacttgcaacgcccgcattgtgtcgacgaaggcttttggctcctctgtcgctgtctcaagcagcatctaaccctgcgtcgccgtttccatttgcagccgctggcccgccgagccctggaggagctcgggctgccggtgccgccggtgctgcgggtgcccggcgagagcaccaaccccgtactggtcggcgagcccggcccggtgatcaagctgttcggcgagcactggtgcggtccggagagcctcgcgtcggagtcggaggcgtacgcggtcctggcggacgccccggtgccggtgccccgcctcctcggccgcggcgagctgcggcccggcaccggagcctggccgtggccctacctggtgatgagccggatgaccggcaccacctggcggtccgcgatggacggcacgaccgaccggaacgcgctgctcgccctggcccgcgaactcggccgggtgctcggccggctgcacagggtgccgctgaccgggaacaccgtgctcaccccccattccgaggtcttcccggaactgctgcgggaacgccgcgcggcgaccgtcgaggaccaccgcgggtggggctacctctcgccccggctgctggaccgcctggaggactggctgccggacgtggacacgctgctggccggccgcgaaccccggttcgtccacggcgacctgcacgggaccaacatcttcgtggacctggccgcgaccgaggtcaccgggatcgtcgacttcaccgacgtctatgcgggagactcccgctacagcctggtgcaactgcatctcaacgccttccggggcgaccgcgagatcctggccgcgctgctcgacggggcgcagtggaagcggaccgaggacttcgcccgcgaactgctcgccttcaccttcctgcacgacttcgaggtgttcgaggagaccccgctggatctctccggcttcaccgatccggaggaactggcgcagttcctctgggggccgccggacaccgcccccggcgcctgataaggatccggcaagactggccccgcttggcaacgcaacagtgagcccctccctagtgtgtttggggatgtgactatgtattcgtgtgttggccaacgggtcaacccgaacagattgatacccgccttggcatttcctgtcagaatgtaacgtcagttgatggtact

SEQ ID NO: 51 - protein, 305 aa, Streptococcus pyogenes
KKYSIGLAIGTNSVGWAVITDEYKVPSKKFKVLGNTDRHSIKKNLIGALLFDSGETAEATRLKRTARRRYTRRKNRILYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILR

SEQ ID NO: 52 - protein, 326 aa, Streptococcus pyogenes
KAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIEEFDSVEISGVEDRFNASLGTYHDLLKIIKDKDFLDNEENEDILEDIVLTLTLFEDREMIEERLKTY

SEQ ID NO: 53 - protein, 70 aa, Streptococcus pyogenes
DDKVMKQLKRRRYTGWGRLSRKLINGIRDKQSGKTILDFLKSDGFANRNFMQLIHDDSLTFKEDIQKAQV

SEQ ID NO: 54 - protein, 50 aa, Streptococcus pyogenes
DSLHEHIANLAGSPAIKKGILQTVKVVDELVKVMGRHKPENIVIEMAREN

SEQ ID NO: 55 - protein, 19 aa, Streptococcus pyogenes
KNSRERMKRIEEGIKELGS

SEQ ID NO: 56 - protein, 145 aa, Streptococcus pyogenes
KEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNT

SEQ ID NO: 57 - protein, 58 aa, Streptococcus pyogenes
REVKVITLKSKLVSDFRKDFQFYKVREINNYHHAHDAYLNAVVGTALIKKYPKLESEF

SEQ ID NO: 58 - protein, 19 aa, Streptococcus pyogenes
GKATAKYFFYSNIMNFFKT

SEQ ID NO: 59 - protein, 180 aa, Streptococcus pyogenes
IETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHY

SEQ ID NO: 60 - protein, 118 aa, Streptococcus pyogenes
PEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLG

SEQ ID NO: 61 - RNA, 97 nt, Streptococcus pyogenes
ggaaauugggugcgcuuggcguuuuagagcuagaaauagcaaguuaaaauaaggcuaguccguuaucaacuugagaaaguggcaccgagucggugcu

SEQ ID NO: 62 - DNA, 20 bp, Streptococcus pyogenes
gccaagcgcacccaatttcc

SEQ ID NO: 63 - protein, 567 aa, Streptococcus pyogenes
KKYSIGLAIGTNSVGWAVITDEYKVPSKKFKVLGNTDRHSIKKNLIGALLFDSGETAEATRLKRTARRRYTRRKNRILYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYF

SEQ ID NO: 64 - protein, 62 aa, Streptococcus pyogenes
VEISGVEDRFNASLGTYHDLLKIIKDKDFLDNEENEDILEDIVLTLTLFEDREMIEERLKTY

SEQ ID NO: 65 - protein, 69 aa, Streptococcus pyogenes
DDKVMKQLKRRRYTGWGRLSRKLINGIRDKQSGKTILDFLKSDGFANRNFMQLIHDDSLTFKEDIQKAQ

SEQ ID NO: 66 - protein, 46 aa, Streptococcus pyogenes
DSLHEHIANLAGSPAIKKGILQTVKVVDELVKVMGRHKPENIVIEM

SEQ ID NO: 67 - protein, 94 aa, Streptococcus pyogenes
RQLVETRQITKHVAQILDSRMNTKYDENDKLIREVKVITLKSKLVSDFRKDFQFYKVREINNYHHAHDAYLNAVVGTALIKKYPKLESEFVYGD

SEQ ID NO: 68 - protein, 10 aa, Streptococcus pyogenes
YSNIMNFFKT

SEQ ID NO: 69 - protein, 50 aa, Streptococcus pyogenes
TNGETGEIVWDKGRDFATVRKVLSMPQVNIVKKTEVQTGGFSKESILPKR

SEQ ID NO: 70 - protein, 127 aa, Streptococcus pyogenes
DKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYE

SEQ ID NO: 71 - protein, 117 aa, Streptococcus pyogenes
EDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLG

SEQ ID NO: 72 - RNA, 97 nt, Streptococcus pyogenes; identical to SEQ ID NO: 61

SEQ ID NO: 73 - DNA, 20 bp, Streptococcus pyogenes
gccaagcgcacccaatttcc

SEQ ID NO: 74 - DNA, 4203 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 75 - DNA, 51 bp, Artificial Sequence
  source: /note="Description of Artificial Sequence: Synthetic oligonucleotide"
atggccccaaagaagaagcggaaggtcggtatccacggagtcccagcagcc

SEQ ID NO: 76 - DNA, 171 bp, Artificial Sequence
  source: /note="Description of Artificial Sequence: Synthetic polynucleotide"
gacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaaca

SEQ ID NO: 77 - DNA, 84 bp, Artificial Sequence
  source: /note="Description of Artificial Sequence: Synthetic oligonucleotide"
gccgaggccacccggctgaagagaaccgccagaagaagatacaccagacggaagaaccggatctgctatctgcaagagatcttc

SEQ ID NO: 78 - DNA, 261 bp, Artificial Sequence
  source: /note="Description of Artificial Sequence: Synthetic polynucleotide"
agcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgac

SEQ ID NO: 79 - DNA, 414 bp, Artificial Sequence
  source: /note="Description of Artificial Sequence: Synthetic polynucleotide"
ctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgag

SEQ ID NO: 80 - DNA, 1200 bp, Artificial Sequence
  source: /note="Description of Artificial Sequence: Synthetic polynucleotide"
atcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcc

SEQ ID NO: 81 - DNA, 21 bp, Artificial Sequence
  source: /note="Description of Artificial Sequence: Synthetic oligonucleotide"
caggtgtccggccagggcgat

SEQ ID NO: 82 - DNA, 24 bp, Artificial Sequence
  source: /note="Description of Artificial Sequence: Synthetic oligonucleotide"
atcgtgatcgaaatggccagagag

SEQ ID NO: 83 - DNA, 87 bp, Artificial Sequence
  source: /note="Description of Artificial Sequence: Synthetic oligonucleotide"
gactacgatgtggaccatatcgtgcctcagagctttctgaaggacgactccatcgacaacaaggtgctgaccagaagcgacaagaac

SEQ ID NO: 84 - DNA, 24 bp, Artificial Sequence
  source: /note="Description of Artificial Sequence: Synthetic oligonucleotide"
caccacgcccacgacgcctacctg

SEQ ID NO: 85 - DNA, 813 bp, Artificial Sequence
  source: /note="Description of Artificial Sequence: Synthetic polynucleotide"
accgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgac

SEQ ID NO: 86 - DNA, 48 bp, Artificial Sequence
  source: /note="Description of Artificial Sequence: Synthetic oligonucleotide"
aaaaggccggcggccacgaaaaaggccggccaggcaaaaaagaaaaag

SEQ ID NO: 87 - DNA, 3789 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacatcaccaaggcaccactgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 88 - DNA, 3834 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacggtggcggtggctcgggtggcggtggctcgggtggcggtggctcgatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 89 - DNA, 3879 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacggtggcggtggctcgggtggcggtggctcgggtggcggtggctcgggtggcggtggctcgggtggcggtggctcgggtggcggtggctcgatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 90 - DNA, 3924 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacggtggcggtggctcgggtggcggtggctcgggtggcggtggctcgggtggcggtggctcgggtggcggtggctcgggtggcggtggctcgggtggcggtggctcgggtggcggtggctcgggtggcggtggctcgatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 91 - DNA, 3969 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacggtggcggtggctcgggtggcggtggctcgggtggcggtggctcgggtggcggtggctcgggtggcggtggctcgggtggcggtggctcgggtggcggtggctcgggtggcggtggctcgggtggcggtggctcgggtggcggtggctcgggtggcggtggctcgggtggcggtggctcgatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 92 - DNA, 3840 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacgctgaagctgctgctaaagaagctgctgctaaagaagctgctgctaaagctatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 93 - protein, 36 aa, Artificial Sequence
  source: /note="Description of Artificial Sequence: Synthetic polypeptide"
AEAAAKEAAAKEAAAKALEAEAAAKEAAAKEAAAKA

SEQ ID NO: 94 - DNA, 3897 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacgctgaagccgctgctaaagaagccgctgctaaagaagccgctgctaaagccctggaggctgaagccgctgctaaagaagccgctgctaaagaagccgctgctaaagctatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 95 - protein, 55 aa, Artificial Sequence
  source: /note="Description of Artificial Sequence: Synthetic polypeptide"
AEAAAKEAAAKEAAAKALEAEAAAKEAAAKEAAAKALEAEAAAKEAAAKEAAAKA

SEQ ID NO: 96 - DNA, 3954 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacgctgaagctgctgctaaagaagctgctgctaaagaagctgctgctaaagccctggaggctgaagctgctgctaaagaagctgctgctaaagaagctgctgctaaagccctggaggctgaagctgctgctaaagaagctgctgctaaagaagctgctgctaaagctatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 97 - protein, 74 aa, Artificial Sequence
  source: /note="Description of Artificial Sequence: Synthetic polypeptide"
AEAAAKEAAAKEAAAKALEAEAAAKEAAAKEAAAKALEAEAAAKEAAAKEAAAKALEAEAAAKEAAAKEAAAKA

SEQ ID NO: 98 - DNA, 4011 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacgctgaagctgctgctaaagaagctgctgctaaagaagctgctgctaaagccctggaggctgaagctgctgctaaagaagctgctgctaaagaagctgctgctaaagccctggaggctgaagctgctgctaaagaagctgctgctaaagaagctgctgctaaagccctggaggctgaagctgctgctaaagaagctgctgctaaagaagctgctgctaaagctatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 99 - DNA, 3804 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctggtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 100 - DNA, 3393 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccaaaaggccggcggccacgaaaaaggccggccaggcaaaaaagaaaaagtaa

SEQ ID NO: 101 - DNA, 3849 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgggtggaggtggctcgggtggaggtggctcgggtggaggtggctcggtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 102 - DNA, 3894 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgggtggaggtggctcgggtggaggtggctcgggtggaggtggctcgggtggaggtggctcgggtggaggtggctcgggtggaggtggctcggtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 103 - DNA, 3939 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgggtggaggtggctcgggtggaggtggctcgggtggaggtggctcgggtggaggtggctcgggtggaggtggctcgggtggaggtggctcgggtggaggtggctcgggtggaggtggctcgggtggaggtggctcggtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 104 - DNA, 3984 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgggtggaggtggttcgggtggcggtggctcgggtggaggtggatcgggtggcggtggttcgggtggaggtggctcgggcggaggtggatcgggtggcggtggctcgggtggaggtggctcgggtggaggtggctcgggtggcggtggatcgggtggaggtggatcgggtggaggtggttcggtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 105 - DNA, 3855 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctggctgaagctgctgctaaagaagctgctgctaaagaagctgctgctaaagctgtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 106 - DNA, 3912 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctggctgaagccgctgctaaagaagccgctgctaaagaagccgctgctaaagccctggaggctgaagccgctgctaaagaagccgctgctaaagaagccgctgctaaagctgtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 107 - DNA, 3969 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctggctgaagctgctgctaaagaagctgctgctaaagaagctgctgctaaagccctggaggctgaagctgctgctaaagaagctgctgctaaagaagctgctgctaaagccctggaggctgaagctgctgctaaagaagctgctgctaaagaagctgctgctaaagctgtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 108 - DNA, 4026 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctggctgaagctgctgctaaagaagctgctgctaaagaagctgctgctaaagccctggaggctgaagctgctgctaaagaagctgctgctaaagaagctgctgctaaagccctggaggctgaagctgctgctaaagaagctgctgctaaagaagctgctgctaaagccctggaggctgaagctgctgctaaagaagctgctgctaaagaagctgctgctaaagctgtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 109 - DNA, 4203 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaacgccgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 110 - DNA, 4203 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgccatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 111 - DNA, 4203 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactacgcccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 112 - DNA, 4203 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccacgccgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaagtaa

SEQ ID NO: 113 - DNA, 4200 bp, Artificial Sequence
  source: /note="Description of Artificial Sequence: Synthetic polynucleotide"
atggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgccgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaag

SEQ ID NO: 114 - DNA, 4269 bp, Artificial Sequence
  source: /note="Description of Artificial Sequence: Synthetic polynucleotide"
atggactataaggaccacgacggagactacaaggatcatgatattgattacaaagacgatgacgataagatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaag

SEQ ID NO: 115 - DNA, 4107 bp, Artificial Sequence
  source: /note="Description of Artificial Sequence: Synthetic polynucleotide"
atggactataaggaccacgacggagactacaaggatcatgatattgattacaaagacgatgacgataagatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaag

SEQ ID NO: 116 - DNA, 3870 bp, Artificial Sequence
  source: /note="Description of Artificial Sequence: Synthetic polynucleotide"
atggactataaggaccacgacggagactacaaggatcatgatattgattacaaagacgatgacgataagatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctggtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaag

SEQ ID NO: 117 - DNA, 3975 bp, Artificial Sequence
  source: /note="Description of Artificial Sequence: Synthetic polynucleotide"
atggactataaggaccacgacggagactacaaggatcatgatattgattacaaagacgatgacgataagatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaag

SEQ ID NO: 118 - DNA, 3459 bp, Artificial Sequence
  source: /note="Description of Artificial Sequence: Synthetic polynucleotide"
atggactataaggaccacgacggagactacaaggatcatgatattgattacaaagacgatgacgataagatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccaaaaggccggcggccacgaaaaaggccggccaggcaaaaaagaaaaag

SEQ ID NO: 119 - DNA, 4347 bp, Artificial Sequence
  source: /note="Description of Artificial Sequence: Synthetic polynucleotide"
atggactataaggaccacgacggagactacaaggatcatgatattgattacaaagacgatgacgataagatggccccaaagaagaagcggaaggtcggtatccacggagtcccagcagccaccaagccctacagcatcggcctggacatcggcaccaatagcgtgggctgggccgtgaccaccgacaactacaaggtgcccagcaagaaaatgaaggtgctgggcaacacctccaagaagtacatcaagaaaaacctgctgggcgtgctgctgttcgacagcggcattacagccgagggcagacggctgaagagaaccgccagacggcggtacacccggcggagaaacagaatcctgtatctgcaagagatcttcagcaccgagatggctaccctggacgacgccttcttccagcggctggacgacagcttcctggtgcccgacgacaagcgggacagcaagtaccccatcttcggcaacctggtggaagagaaggcctaccacgacgagttccccaccatctaccacctgagaaagtacctggccgacagcaccaagaaggccgacctgagactggtgtatctggccctggcccacatgatcaagtaccggggccacttcctgatcgagggcgagttcaacagcaagaacaacgacatccagaagaacttccaggacttcctggacacctacaacgccatcttcgagagcgacctgtccctggaaaacagcaagcagctggaagagatcgtgaaggacaagatcagcaagctggaaaagaaggaccgcatcctgaagctgttccccggcgagaagaacagcggaatcttcagcgagtttctgaagctgatcgtgggcaaccaggccgacttcagaaagtgcttcaacctggacgagaaagccagcctgcacttcagcaaagagagctacgacgaggacctggaaaccctgctgggatatatcggcgacgactacagcgacgtgttcctgaaggccaagaagctgtacgacgctatcctgctgagcggcttcctgaccgtgaccgacaacgagacagaggccccactgagcagcgccatgattaagcggtacaacgagcacaaagaggatctggctctgctgaaagagtacatccggaacatcagcctgaaaacctacaatgaggtgttcaaggacgacaccaagaacggctacgccggctacatcgacggcaagaccaaccaggaagaggaagatttctatgtgtacctgaagaagctgctggccgagttcgagggggccgactactttctggaaaaaatcgaccgcgaggatttcctgcggaagcagcggaccttcgacaacggcagcatcccctaccagatccatctgcaggaaatgcgggccatcctggacaagcaggccaagttctacccattcctggccaagaacaaagagcggatcgagaagatcctgaccttccgcatcccttactacgtgggccccctggccagaggcaacagcgattttgcctggtccatccggaagcgcaatgagaagatcaccccctggaacttcgaggacgtgatcgacaaagagtccagcgccgaggccttcatcaaccggatgaccagcttcgacctgtacctgcccgaggaaaaggtgctgcccaagcacagcctgctgtacgagacattcaatgtgtataacgagctgaccaaagtgcggtttatcgccgagtctatgcgggactaccagttcctggactccaagcagaaaaaggacatcgtgcggctgtacttcaaggacaagcggaaagtgaccgataaggacatcatcgagtacctgcacgccatctacggctacgatggcatcgagctgaagggcatcgagaagcagttcaactccagcctgagcacataccacgacctgctgaacattatcaacgacaaagaatttctggacgactccagcaacgaggccatcatcgaagagatcatccacaccctgaccatctttgaggaccgcgagatgatcaagcagcggctgagcaagttcgagaacatcttcgacaagagcgtgctgaaaaagctgagcagacggcactacaccggctggggcaagctgagcgccaagctgatcaacggcatccgggacgagaagtccggcaacacaatcctggactacctgatcgacgacggcatcagcaaccggaacttcatgcagctgatccacgacgacgccctgagcttcaagaagaagatccagaaggcccagatcatcggggacgaggacaagggcaacatcaaagaagtcgtgaagtccctgcccggcagccccgccatcaagaagggaatcctgcagagcatcaagatcgtggacgagctcgtgaaagtgatgggcggcagaaagcccgagagcatcgtggtggtggtggaaatggctagagagaaccagtacaccaatcagggcaagagcaacagccagcagagactgaagagactggaaaagtccctgaaagagctgggcagcaagattctgaaagagaatatccctgccaagctgtccaagatcgacaacaacgccctgcagaacgaccggctgtacctgtactacctgcagaatggcaaggacatgtatacaggcgacgacctggatatcgaccgcctgagcaactacgacatcgaccatattatcccccaggccttcctgaaagacaacagcattgacaacaaagtgctggtgtcctccgccagcaaccgcggcaagtccgatgatgtgcccagcctggaagtcgtgaaaaagagaaagaccttctggtatcagctgctgaaaagcaagctgattagccagaggaagttcgacaacctgaccaaggccgagagaggcggcctgagccctgaagataaggccggcttcatccagagacagctggtggaaacccggcagatcaccaagcacgtggccagactgctggatgagaagtttaacaacaagaaggacgagaacaaccgggccgtgcggaccgtgaagatcatcaccctgaagtccaccctggtgtcccagttccggaaggacttcgagctgtataaagtgcgcgagatcaatgactttcaccacgcccacgacgcctacctgaatgccgtggtggcttccgccctgctgaagaagtaccctaagctggaacccgagttcgtgtacggcgactaccccaagtacaactccttcagagagcggaagtccgccaccgagaaggtgtacttctactccaacatcatgaatatctttaagaagtccatctccctggccgatggcagagtgatcgagcggcccctgatcgaagtgaacgaagagacaggcgagagcgtgtggaacaaagaaagcgacctggccaccgtgcggcgggtgctgagttatcctcaagtgaatgtcgtgaagaaggtggaagaacagaaccacggcctggatcggggcaagcccaagggcctgttcaacgccaacctgtccagcaagcctaagcccaactccaacgagaatctcgtgggggccaaagagtacctggaccctaagaagtacgggtacggcggatacgccggcatctccaatagcttcaccgtgctcgtgaagggcacaatcgagaagggcgctaagaaaaagatcacaaacgtgctggaatttcaggggatctctatcctggaccggatcaactaccggaaggataagctgaactttctgctggaaaaaggctacaaggacattgagctgattatcgagctgcctaagtactccctgttcgaactgagcgacggctccagacggatgctggcctccatcctgtccaccaacaacaagcggggcgagatccacaagggaaaccagatcttcctgagccagaaatttgtgaaactgctgtaccacgccaagcggatctccaacaccatcaatgagaaccaccggaaatacgtggaaaaccacaagaaagagtttgaggaactgttctactacatcctggagttcaacgagaactatgtgggagccaagaagaacggcaaactgctgaactccgccttccagagctggcagaaccacagcatcgacgagctgtgcagctccttcatcggccctaccggcagcgagcggaagggactgtttgagctgacctccagaggctctgccgccgactttgagttcctgggagtgaagatcccccggtacagagactacaccccctctagtctgctgaaggacgccaccctgatccaccagagcgtgaccggcctgtacgaaacccggatcgacctggctaagctgggcgagggaaaaaggccggcggccacgaaaaaggccggccaggcaaaaaagaaaaag

SEQ ID NO: 120 - DNA, 4104 bp, Artificial Sequence
  source: /note="Description of Artificial Sequence: Synthetic polynucleotide"
atggacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatcctgtatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgaggagttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgac

SEQ ID NO: 121 - DNA, 4338 bp, Artificial Sequence
  source: /note="Description of Artificial Sequence: Synthetic polynucleotide"
atggactataaggaccacgacggagactacaaggatcatgatattgattacaaagacgatgacgataagatggccccaaagaagaagcggaaggtcggtatccacggagtcccagcagccgacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgtggaagaacagaaccacggcctggatcggggcaagcccaagggcctgttcaacgccaacctgtccagcaagcctaagcccaactccaacgagaatctcgtgggggccaaagagtacctggaccctaagaagtacgggtacggcggatacgccggcatctccaatagcttcaccgtgctcgtgaagggcacaatcgagaagggcgctaagaaaaagatcacaaacgtgctggaatttcaggggatctctatcctggaccggatcaactaccggaaggataagctgaactttctgctggaaaaaggctacaaggacattgagctgattatcgagctgcctaagtactccctgttcgaactgagcgacggctccagacggatgctggcctccatcctgtccaccaacaacaagcggggcgagatccacaagggaaaccagatcttcctgagccagaaatttgtgaaactgctgtaccacgccaagcggatctccaacaccatcaatgagaaccaccggaaatacgtggaaaaccacaagaaagagtttgaggaactgttctactacatcctggagttcaacgagaactatgtgggagccaagaagaacggcaaactgctgaactccgccttccagagctggcagaaccacagcatcgacgagctgtgcagctccttcatcggccctaccggcagcgagcggaagggactgtttgagctgacctccagaggctctgccgccgactttgagttcctgggagtgaagatcccccggtacagagactacaccccctctagtctgctgaaggacgccaccctgatccaccagagcgtgaccggcctgtacgaaacccggatcgacctggctaagctgggcgagggaaaaaggccggcggccacgaaaaaggccggccaggcaaaaaagaaaaag

SEQ ID NO: 122 - DNA, 4215 bp, Artificial Sequence
  source: /note="Description of Artificial Sequence: Synthetic polynucleotide"
atggccccaaagaagaagcggaaggtcggtatccacggagtcccagcagccatgaccaagccctacagcatcggcctggacatcggcaccaatagcgtgggctgggccgtgaccaccgacaactacaaggtgcccagcaagaaaatgaaggtgctgggcaacacctccaagaagtacatcaagaaaaacctgctgggcgtgctgctgttcgacagcggcattacagccgagggcagacggctgaagagaaccgccagacggcggtacacccggcggagaaacagaatcctgtatctgcaagagatcttcagcaccgagatggctaccctggacgacgccttcttccagcggctggacgacagcttcctggtgcccgacgacaagcgggacagcaagtaccccatcttcggcaacctggtggaagagaaggcctaccacgacgagttccccaccatctaccacctgagaaagtacctggccgacagcaccaagaaggccgacctgagactggtgtatctggccctggcccacatgatcaagtaccggggccacttcctgatcgagggcgagttcaacagcaagaacaacgacatccagaagaacttccaggacttcctggacacctacaacgccatcttcgagagcgacctgtccctggaaaacagcaagcagctggaagagatcgtgaaggacaagatcagcaagctggaaaagaaggaccgcatcctgaagctgttccccggcgagaagaacagcggaatcttcagcgagtttctgaagctgatcgtgggcaaccaggccgacttcagaaagtgcttcaacctggacgagaaagccagcctgcacttcagcaaagagagctacgacgaggacctggaaaccctgctgggatatatcggcgacgactacagcgacgtgttcctgaaggccaagaagctgtacgacgctatcctgctgagcggcttcctgaccgtgaccgacaacgagacagaggccccactgagcagcgccatgattaagcggtacaacgagcacaaagaggatctggctctgctgaaagagtacatccggaacatcagcctgaaaacctacaatgaggtgttcaaggacgacaccaagaacggctacgccggctacatcgacggcaagaccaaccaggaagaggaagatttctatgtgtacctgaagaagctgctggccgagttcgagggggccgactactttctggaaaaaatcgaccgcgaggatttcctgcggaagcagcggaccttcgacaacggcagcatcccctaccagatccatctgcaggaaatgcgggccatcctggacaagcaggccaagttctacccattcctggccaagaacaaagagcggatcgagaagatcctgaccttccgcatcccttactacgtgggccccctggccagaggcaacagcgattttgcctggtccatccggaagcgcaatgagaagatcaccccctggaacttcgaggacgtgatcgacaaagagtccagcgccgaggccttcatcaaccggatgaccagcttcgacctgtacctgcccgaggaaaaggtgctgcccaagcacagcctgctgtacgagacattcaatgtgtataacgagctgaccaaagtgcggtttatcgccgagtctatgcgggactaccagttcctggactccaagcagaaaaaggacatcgtgcggctgtacttcaaggacaagcggaaagtgaccgataaggacatcatcgagtacctgcacgccatctacggctacgatggcatcgagctgaagggcatcgagaagcagttcaactccagcctgagcacataccacgacctgctgaacattatcaacgacaaagaatttctggacgactccagcaacgaggccatcatcgaagagatcatccacaccctgaccatctttgaggaccgcgagatgatcaagcagcggctgagcaagttcgagaacatcttcgacaagagcgtgctgaaaaagctgagcagacggcactacaccggctggggcaagctgagcgccaagctgatcaacggcatccgggacgagaagtccggcaacacaatcctggactacctgatcgacgacggcatcagcaaccggaacttcatgcagctgatccacgacgacgccctgagcttcaagaagaagatccagaaggcccagatcatcggggacgaggacaagggcaacatcaaagaagtcgtgaagtccctgcccggcagccccgccatcaagaagggaatcctgcagagcatcaagatcgtggacgagctcgtgaaagtgatgggcggcagaaagcccgagagcatcgtggtggtggtggaaatggctagagagaaccagtacaccaatcagggcaagagcaacagccagcagagactgaagagactggaaaagtccctgaaagagctgggcagcaagattctgaaagagaatatccctgccaagctgtccaagatcgacaacaacgccctgcagaacgaccggctgtacctgtactacctgcagaatggcaaggacatgtatacaggcgacgacctggatatcgaccgcctgagcaactacgacatcgaccatattatcccccaggccttcctgaaagacaacagcattgacaacaaagtgctggtgtcctccgccagcaaccgcggcaagtccgatgatgtgcccagcctggaagtcgtgaaaaagagaaagaccttctggtatcagctgctgaaaagcaagctgattagccagaggaagttcgacaacctgaccaaggccgagagaggcggcctgagccctgaagataaggccggcttcatccagagacagctggtggaaacccggcagatcaccaagcacgtggccagactgctggatgagaagtttaacaacaagaaggacgagaacaaccgggccgtgcggaccgtgaagatcatcaccctgaagtccaccctggtgtcccagttccggaaggacttcgagctgtataaagtgcgcgagatcaatgactttcaccacgcccacgacgcctacctgaatgccgtggtggcttccgccctgctgaagaagtaccctaagctggaacccgagttcgtgtacggcgactaccccaagtacaactccttcagagagcggaagtccgccaccgagaaggtgtacttctactccaacatcatgaatatctttaagaagtccatctccctggccgatggcagagtgatcgagcggcccctgatcgaagtgaacgaagagacaggcgagagcgtgtggaacaaagaaagcgacctggccaccgtgcggcgggtgctgagttatcctcaagtgaatgtcgtgaagaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacaaaaggccggcggccacgaaaaaggccggccaggcaaaaaagaaaaag

SEQ ID NO: 123 - DNA, 4269 bp, Artificial Sequence; identical to SEQ ID NO: 114
  source: /note="Description of Artificial Sequence: Synthetic polynucleotide"

SEQ ID NO: 124 - DNA, 4269 bp, Artificial Sequence; identical to SEQ ID NO: 114
  source: /note="Description of Artificial Sequence: Synthetic polynucleotide"

SEQ ID NO: 125 - RNA, 100 nt, Artificial Sequence
  source: /note="Description of Artificial Sequence: Synthetic polynucleotide"
gaguccgagcagaagaagaagccccagagcuagaaauagcaaguugggguaaggcuaguccguuaucaacuugaaaaaguggcaccgagucggugcuuuu

SEQ ID NO: 126 - RNA, 66 nt, Artificial Sequence
  source: /note="Description of Artificial Sequence: Synthetic oligonucleotide"
gaguccgagcagaagaagaaguuuuagagcuagaaauagcaaguuaaaauaaggcuaguccguuuu

SEQ ID NO: 127 - RNA, 85 nt, Artificial Sequence
  source: /note="Description of Artificial Sequence: Synthetic oligonucleotide"
gaguccgagcagaagaagaaguuuuagagcuagaaauagcaaguuaaaauaaggcuaguccguuaucaacuugaaaaaguguuuu

SEQ ID NO: 128 - RNA, 100 nt, Artificial Sequence; identical to SEQ ID NO: 125
  source: /note="Description of Artificial Sequence: Synthetic polynucleotide"

SEQ ID NO: 129 - RNA, 91 nt, Artificial Sequence
  source: /note="Description of Artificial Sequence: Synthetic oligonucleotide"
gaguccgagcagaagaagaaguuuuagagacaaguuaaaauaaggcuaguccguuaucaacuugaaaaaguggcaccgagucggugcuuuu

SEQ ID NO: 130 - RNA, 98 nt, Artificial Sequence
  source: /note="Description of Artificial Sequence: Synthetic oligonucleotide"
gaguccgagcagaagaagaaguuuuagagcuagaaauagcuuuaaaauaaggcuaguccguuaucaacuugaaaaaguggcaccgagucggugcuuuu

SEQ ID NO: 131 - RNA, 100 nt, Artificial Sequence
  source: /note="Description of Artificial Sequence: Synthetic polynucleotide"
gaguccgagcagaagaagaaguuuuagagcuagaaauagcaaguuaaaauaauucuaguaaguuaucaacuugaaaaaguggcaccgagucggugcuuuu

SEQ ID NO: 132 - RNA, 100 nt, Artificial Sequence
  source: /note="Description of Artificial Sequence: Synthetic polynucleotide"
gaguccgagcagaagaagaaguuuuagagcuagaaauagcaaguuaaaauaagccaugugcguuaucaacuugaaaaaguggcaccgagucggugcuuuu

SEQ ID NO: 133 - RNA, 96 nt, Artificial Sequence
  source: /note="Description of Artificial Sequence: Synthetic oligonucleotide"
gaguccgagcagaagaagaaguuuuagagcuagaaauagcaaguuaaaauaaggcuaguccguaacuugaaaaaguggcaccgagucggugcuuuu

SEQ ID NO: 134 - RNA, 100 nt, Artificial Sequence
  source: /note="Description of Artificial Sequence: Synthetic polynucleotide"
gaguccgagcagaagaagaaguuuuagagcuagaaauagcaaguuaaaauaaggcuaguccguuaucacgccgaaaggcgggcaccgagucggugcuuuu

SEQ ID NO: 135 - RNA, 104 nt, Artificial Sequence
  source: /note="Description of Artificial Sequence: Synthetic polynucleotide"
gaguccgagcagaagaagaaguuuuagagcuagaaauagcaaguuaaaauaaggcuaguccguuaucaacuugagaaaucaaguggcaccgagucggugcuuuu

SEQ ID NO: 136 - RNA, 100 nt, Artificial Sequence
  source: /note="Description of Artificial Sequence: Synthetic polynucleotide"
gaguccgagcagaagaagaaguuuuagagcuagaaauagcaaguuaaaauaaggcuaguccguuaucaacuugaaaaaguggccccgcggcggggcuuuu

SEQ ID NO: 137 - RNA, 104 nt, Artificial Sequence
  source: /note="Description of Artificial Sequence: Synthetic polynucleotide"
gaguccgagcagaagaagaaguuuuagagcuagaaauagcaaguuaaaauaaggcuaguccguuaucaacuugaaaaaguggcaccgaaaguuucggugcuuuu

SEQ ID NO: 138 - RNA, 96 nt, Artificial Sequence
  source: /note="Description of Artificial Sequence: Synthetic oligonucleotide"
gaguccgagcagaagaagaagccccagagcauuagcaaguugggguaagccaugugcguuaucagggcaccagcccggcaccgagucggugcuuuu

SEQ ID NO: 139 - RNA, 100 nt, Artificial Sequence
  source: /note="Description of Artificial Sequence: Synthetic polynucleotide"
gaguccgagcagaagaagaaguuuuagagcuagaaauagcaacuuaaaauaaggcuaguccguuaucaacuugaaaaaguggcaccgagucggugcuuuu

SEQ ID NO: 140 - RNA, 100 nt, Artificial Sequence
  source: /note="Description of Artificial Sequence: Synthetic polynucleotide"
gaguccgagcagaagaagaaguuuuagagcuagaaauagcaagguaaaauaaggcuaguccguuaucaacuugaaaaaguggcaccgagucggugcuuuu

SEQ ID NO: 141 - RNA, 100 nt, Artificial Sequence
  source: /note="Description of Artificial Sequence: Synthetic polynucleotide"
gaguccgagcagaagaagaaguuuuagagcuagaaauagcaagcuaaaauaaggcuaguccguuaucaacuugaaaaaguggcaccgagucggugcuuuu

SEQ ID NO: 142 - DNA, 23 bp, Artificial Sequence
  source: /note="Description of Artificial Sequence: Synthetic primer"
gagtccgagcagaagaagaaggg

SEQ ID NO: 143 - DNA, 20 bp, Artificial Sequence
  source: /note="Description of Artificial Sequence: Synthetic primer"
ccatccccttctgtgaatgt

SEQ ID NO: 144 - DNA, 20 bp, Artificial Sequence
  source: /note="Description of Artificial Sequence: Synthetic primer"
ggagattggagacacggaga

SEQ ID NO: 145 - DNA, 25 bp, Artificial Sequence
  source: /note="Description of Artificial Sequence: Synthetic primer"
gctcccatcacatcaaccggtggcg

SEQ ID NO: 146 - DNA, 21 bp, Artificial Sequence
  source: /note="Description of Artificial Sequence: Synthetic oligonucleotide"
gatacgatgaaaagaataagc

SEQ ID NO: 147 - DNA, 131 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngttttagagctaggccaacatgaggatcacccatgtctgcagggcctagcaagttaaaataaggctagtccgttatcacgccgaaaggcgggcaccgagtcggtgcttttt

SEQ ID NO: 148 - DNA, 131 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngttttagagctagaaatagcaagttaaaataaggctagtccgttatcaacttggccaacatgaggatcacccatgtctgcagggccaagtggcaccgagtcggtgcttttt

SEQ ID NO: 149 - DNA, 161 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngttttagagctaggccaacatgaggatcacccatgtctgcagggcctagcaagttaaaataaggctagtccgttatcaacttggccaacatgaggatcacccatgtctgcagggccaagtggcaccgagtcggtgcttttt

SEQ ID NO: 150 - DNA, 101 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngttttagagctagaaatagcaagttaaaataaggctagtccgttatcaacttgaaaaagtggcaccgagtcggtgcttttt

SEQ ID NO: 151 - DNA, 645 bp, Artificial Sequence
  source: /note="Description of Artificial Sequence: Synthetic polynucleotide"
atggcttcaaactttactcagttcgtgctcgtggacaatggtgggacaggggatgtgacagtggctccttctaatttcgctaatggggtggcagagtggatcagctccaactcacggagccaggcctacaaggtgacatgcagcgtcaggcagtctagtgcccagaagagaaagtataccatcaaggtggaggtccccaaagtggctacccagacagtgggcggagtcgaactgcctgtcgccgcttggaggtcctacctgaacatggagctcactatcccaattttcgctaccaattctgactgtgaactcatcgtgaaggcaatgcaggggctcctcaaagacggtaatcctatcccttccgccatcgccgctaactcaggtatctacagcgctggaggaggtggaagcggaggaggaggaagcggaggaggaggtagcggacctaagaaaaagaggaaggtggcggccgctggatccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaac

SEQ ID NO: 152 - DNA, 20 bp, Homo sapiens
gcagccgctcgctgcagcag

SEQ ID NO: 153 - DNA, 20 bp, Homo sapiens
gggcccctgcggccaccccg

SEQ ID NO: 154 - DNA, 103 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngttttagagctagaaatagcaagttaaaataaggctagtccgttatcaacttgaaaaagtggcaccgagtcggtgcttttttt

SEQ ID NO: 155 - DNA, 113 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngtttaagagctatgctggaaacagcatagcaagtttaaataaggctagtccgttatcaacttgaaaaagtggcaccgagtcggtgcttttttt

SEQ ID NO: 156 - DNA, 163 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngttttagagctaggccaacatgaggatcacccatgtctgcagggcctagcaagttaaaataaggctagtccgttatcaacttggccaacatgaggatcacccatgtctgcagggccaagtggcaccgagtcggtgcttttttt

SEQ ID NO: 157 - DNA, 173 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngtttaagagctatgctgggccaacatgaggatcacccatgtctgcagggcccagcatagcaagtttaaataaggctagtccgttatcaacttggccaacatgaggatcacccatgtctgcagggccaagtggcaccgagtcggtgcttttttt

SEQ ID NO: 158 - DNA, 44 bp, Artificial Sequence
  source: /note="Description of Artificial Sequence: Synthetic oligonucleotide"
tgctgggccaacatgaggatcacccatgtctgcagggcccagca

SEQ ID NO: 159 - DNA, 163 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngtttaagagctaggccaacatgaggatcacccatgtctgcagggcctagcaagtttaaataaggctagtccgttatcaacttggccaacatgaggatcacccatgtctgcagggccaagtggcaccgagtcggtgcttttttt

SEQ ID NO: 160 - DNA, 133 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngttttagagctaggccaacatgaggatcacccatgtctgcagggcctagcaagttaaaataaggctagtccgttatcacgccgaaaggcgggcaccgagtcggtgcttttttt

SEQ ID NO: 161 - DNA, 133 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngttttagagctaggccaacatgaggatcacccatgtctgcagggcctagcaagttaaaataaggctagtccgttatcaacttgaaaaagtggcaccgagtcggtgcttttttt

SEQ ID NO: 162 - DNA, 227 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngttttagagctaggccaacatgaggatcacccatgtctgcagggcctagcaagttaaaataaggctagtccgttatcaacttggccaacatgaggatcacccatgtctgcagggccaagtggcaccgagtcggtgctaacatgaggatcacccatgtctgcagtgcaggtcgactctagaaacatgaggatcacccatgtttttttt

SEQ ID NO: 163 - DNA, 64 bp, Artificial Sequence
  source: /note="Description of Artificial Sequence: Synthetic oligonucleotide"
taacatgaggatcacccatgtctgcagtgcaggtcgactctagaaacatgaggatcacccatgt

SEQ ID NO: 164 - DNA, 193 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngttttagagctaggccaacatgaggatcacccatgtctgcagggcctagcaagttaaaataaggggccaacatgaggatcacccatgtctgcagggcctccgttatcaacttggccaacatgaggatcacccatgtctgcagggccaagtggcaccgagtcggtgcttttttt

SEQ ID NO: 165 - DNA, 645 bp, Artificial Sequence; identical to SEQ ID NO: 151
  source: /note="Description of Artificial Sequence: Synthetic polynucleotide"

SEQ ID NO: 166 - protein, 215 aa, Artificial Sequence
  source: /note="Description of Artificial Sequence: Synthetic polypeptide"
MASNFTQFVLVDNGGTGDVTVAPSNFANGVAEWISSNSRSQAYKVTCSVRQSSAQKRKYTIKVEVPKVATQTVGGVELPVAAWRSYLNMELTIPIFATNSDCELIVKAMQGLLKDGNPIPSAIAANSGIYSAGGGGSGGGGSGGGGSGPKKKRKVAAAGSGRADALDDFDLDMLGSDALDDFDLDMLGSDALDDFDLDMLGSDALDDFDLDMLIN

SEQ ID NO: 167 - DNA, 1032 bp, Artificial Sequence
  source: /note="Description of Artificial Sequence: Synthetic polynucleotide"
atggcttcaaactttactcagttcgtgctcgtggacaatggtgggacaggggatgtgacagtggctccttctaatttcgctaatggggtggcagagtggatcagctccaactcacggagccaggcctacaaggtgacatgcagcgtcaggcagtctagtgcccagaagagaaagtataccatcaaggtggaggtccccaaagtggctacccagacagtgggcggagtcgaactgcctgtcgccgcttggaggtcctacctgaacatggagctcactatcccaattttcgctaccaattctgactgtgaactcatcgtgaaggcaatgcaggggctcctcaaagacggtaatcctatcccttccgccatcgccgctaactcaggtatctacagcgctggaggaggtggaagcggaggaggaggaagcggaggaggaggtagcggacctaagaaaaagaggaaggtggcggccgctggatccccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcag

SEQ ID NO: 168 - protein, 344 aa, Artificial Sequence
  source: /note="Description of Artificial Sequence: Synthetic polypeptide"
MASNFTQFVLVDNGGTGDVTVAPSNFANGVAEWISSNSRSQAYKVTCSVRQSSAQKRKYTIKVEVPKVATQTVGGVELPVAAWRSYLNMELTIPIFATNSDCELIVKAMQGLLKDGNPIPSAIAANSGIYSAGGGGSGGGGSGGGGSGPKKKRKVAAAGSPSGQISNQALALAPSSAPVLAQTMVPSSAMVPLAQPPAPAPVLTPGPPQSLSAPVPKSTQAGEGTLSEALLHLQFDADEDLGALLGNSTDPGVFTDLASVDNSEFQQLLNQGVSMSHSTAEPMLMEYPEAITRLVTGSQRPPDPAPTPLGTSGLPNGLSGDEDFSSIADMDFSALLSQISSSGQ

SEQ ID NO: 169 - DNA, 621 bp, Artificial Sequence
  source: /note="Description of Artificial Sequence: Synthetic polynucleotide"
atgtccaaaaccatcgttctttcggtcggcgaggctactcgcactctgactgagatccagtccaccgcagaccgtcagatcttcgaagagaaggtcgggcctctggtgggtcggctgcgcctcacggcttcgctccgtcaaaacggagccaagaccgcgtatcgcgtcaacctaaaactggatcaggcggacgtcgttgattccggacttccgaaagtgcgctacactcaggtatggtcgcacgacgtgacaatcgttgcgaatagcaccgaggcctcgcgcaaatcgttgtacgatttgaccaagtccctcgtcgcgacctcgcaggtcgaagatcttgtcgtcaaccttgtgccgctgggccgtagcgctggaggaggtggaagcggaggaggaggaagcggaggaggaggtagcggacctaagaaaaagaggaaggtggcggccgctggatccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaac

SEQ ID NO: 170 - protein, 207 aa, Artificial Sequence
  source: /note="Description of Artificial Sequence: Synthetic polypeptide"
MSKTIVLSVGEATRTLTEIQSTADRQIFEEKVGPLVGRLRLTASLRQNGAKTAYRVNLKLDQADVVDSGLPKVRYTQVWSHDVTIVANSTEASRKSLYDLTKSLVATSQVEDLVVNLVPLGRSAGGGGSGGGGSGGGGSGPKKKRKVAAAGSGRADALDDFDLDMLGSDALDDFDLDMLGSDALDDFDLDMLGSDALDDFDLDMLIN

SEQ ID NO: 171 - DNA, 831 bp, Artificial Sequence
  source: /note="Description of Artificial Sequence: Synthetic polynucleotide"
atgtccaaaaccatcgttctttcggtcggcgaggctactcgcactctgactgagatccagtccaccgcagaccgtcagatcttcgaagagaaggtcgggcctctggtgggtcggctgcgcctcacggcttcgctccgtcaaaacggagccaagaccgcgtatcgcgtcaacctaaaactggatcaggcggacgtcgttgattccggacttccgaaagtgcgctacactcaggtatggtcgcacgacgtgacaatcgttgcgaatagcaccgaggcctcgcgcaaatcgttgtacgatttgaccaagtccctcgtcgcgacctcgcaggtcgaagatcttgtcgtcaaccttgtgccgctgggccgtagcgctggaggaggtggaagcggaggaggaggaagcggaggaggaggtagcggacctaagaaaaagaggaaggtggcggccgctggatccatgaacatccagatgctgctggaggccgctgactacctggaacggagagagcgcgaagccgagcacggatatgcttcaatgctgcccggaagcggcatgaatattcagatgctgctggaggctgctgattacctggaaaggcgcgaacgggaggccgaacatggctatgcttccatgctgcctgggtctggaatgaatatccaaatgctgctggaggcagccgattacctggaacggagagaaagagaagccgagcacggatacgccagcatgctgccaggcagcgggatgaacatacaaatgctgctggaggctgccgattacctggagaggcgcgagagagaagctgaacatggctatgcctctatgctgccc

SEQ ID NO: 172 - protein, 277 aa, Artificial Sequence
  source: /note="Description of Artificial Sequence: Synthetic polypeptide"
MSKTIVLSVGEATRTLTEIQSTADRQIFEEKVGPLVGRLRLTASLRQNGAKTAYRVNLKLDQADVVDSGLPKVRYTQVWSHDVTIVANSTEASRKSLYDLTKSLVATSQVEDLVVNLVPLGRSAGGGGSGGGGSGGGGSGPKKKRKVAAAGSMNIQMLLEAADYLERREREAEHGYASMLPGSGMNIQMLLEAADYLERREREAEHGYASMLPGSGMNIQMLLEAADYLERREREAEHGYASMLPGSGMNIQMLLEAADYLERREREAEHGYASMLP

SEQ ID NO: 173 - DNA, 807 bp, Artificial Sequence
  source: /note="Description of Artificial Sequence: Synthetic polynucleotide"
atgtccaaaaccatcgttctttcggtcggcgaggctactcgcactctgactgagatccagtccaccgcagaccgtcagatcttcgaagagaaggtcgggcctctggtgggtcggctgcgcctcacggcttcgctccgtcaaaacggagccaagaccgcgtatcgcgtcaacctaaaactggatcaggcggacgtcgttgattccggacttccgaaagtgcgctacactcaggtatggtcgcacgacgtgacaatcgttgcgaatagcaccgaggcctcgcgcaaatcgttgtacgatttgaccaagtccctcgtcgcgacctcgcaggtcgaagatcttgtcgtcaaccttgtgccgctgggccgtagcgctggaggaggtggaagcggaggaggaggaagcggaggaggaggtagcggacctaagaaaaagaggaaggtggcggccgctggatccgctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagtt

SEQ ID NO: 174 - protein, 269 aa, Artificial Sequence
  source: /note="Description of Artificial Sequence: Synthetic polypeptide"
MSKTIVLSVGEATRTLTEIQSTADRQIFEEKVGPLVGRLRLTASLRQNGAKTAYRVNLKLDQADVVDSGLPKVRYTQVWSHDVTIVANSTEASRKSLYDLTKSLVATSQVEDLVVNLVPLGRSAGGGGSGGGGSGGGGSGPKKKRKVAAAGSALSPQHSAVTQGSIIKNKEGMDAKSLTAWSRTLVTFKDVFVDFTREEWKLLDTAQQIVYRNVMLENYKNLVSLGYQLTKPDVILRLEKGEEPWLVEREIHQETHPDSETAFEIKSSV

SEQ ID NO: 175 - DNA, 1110 bp, Artificial Sequence
  source: /note="Description of Artificial Sequence: Synthetic polynucleotide"
atgtccaaaaccatcgttctttcggtcggcgaggctactcgcactctgactgagatccagtccaccgcagaccgtcagatcttcgaagagaaggtcgggcctctggtgggtcggctgcgcctcacggcttcgctccgtcaaaacggagccaagaccgcgtatcgcgtcaacctaaaactggatcaggcggacgtcgttgattccggacttccgaaagtgcgctacactcaggtatggtcgcacgacgtgacaatcgttgcgaatagcaccgaggcctcgcgcaaatcgttgtacgatttgaccaagtccctcgtcgcgacctcgcaggtcgaagatcttgtcgtcaaccttgtgccgctgggccgtagcgctggaggaggtggaagcggaggaggaggaagcggaggaggaggtagcggacctaagaaaaagaggaaggtggcggccgctggatccactaccaactccactcaggacacactgtatctcagcctccacggcggaatcgactccgccatcccataccccgtgaggagagtcgagcagctgctccagttctcttttctgcccgaactccagttccagaacgccgctgtgaaacagagaatccagcgcctgtgctatagagaggaaaagcggctggctgtcagctccctcgcaaagtggctgggccagctccacaaacagaggctgagagcaccaaagaacccccctgtggccatttgttggatcaatagttacgtgggctatggagtctttgcccgggagtctattcccgcttggagttacatcggcgaatataccggcatcctgcggcgccgacaggctctgtggctcgacgagaacgattactgcttccgctatcctgtgccacgctactcattccgatattttaccatcgacagcgggatgcagggtaacgtcacaaggttcatcaatcactccgataaccctaatctggaggcaatcggggccttcgaaaacggtatcttccatatcatcatcagggccatcaaggatatcctgcccggggaggaactctgttaccactatggacctctgtactggaagcatcgaaagaaaagggaggagttcgtgccacaggaggaa

SEQ ID NO: 176 - protein, 370 aa, Artificial Sequence
  source: /note="Description of Artificial Sequence: Synthetic polypeptide"
MSKTIVLSVGEATRTLTEIQSTADRQIFEEKVGPLVGRLRLTASLRQNGAKTAYRVNLKLDQADVVDSGLPKVRYTQVWSHDVTIVANSTEASRKSLYDLTKSLVATSQVEDLVVNLVPLGRSAGGGGSGGGGSGGGGSGPKKKRKVAAAGSTTNSTQDTLYLSLHGGIDSAIPYPVRRVEQLLQFSFLPELQFQNAAVKQRIQRLCYREEKRLAVSSLAKWLGQLHKQRLRAPKNPPVAICWINSYVGYGVFARESIPAWSYIGEYTGILRRRQALWLDENDYCFRYPVPRYSFRYFTIDSGMQGNVTRFINHSDNPNLEAIGAFENGIFHIIIRAIKDILPGEELCYHYGPLYWKHRKKREEFVPQEE

SEQ ID NO: 177 - DNA, 660 bp, Artificial Sequence
  source: /note="Description of Artificial Sequence: Synthetic polynucleotide"
atgtccaaaaccatcgttctttcggtcggcgaggctactcgcactctgactgagatccagtccaccgcagaccgtcagatcttcgaagagaaggtcgggcctctggtgggtcggctgcgcctcacggcttcgctccgtcaaaacggagccaagaccgcgtatcgcgtcaacctaaaactggatcaggcggacgtcgttgattccggacttccgaaagtgcgctacactcaggtatggtcgcacgacgtgacaatcgttgcgaatagcaccgaggcctcgcgcaaatcgttgtacgatttgaccaagtccctcgtcgcgacctcgcaggtcgaagatcttgtcgtcaaccttgtgccgctgggccgtagcgctggaggaggtggaagcggaggaggaggaagcggaggaggaggtagcggacctaagaaaaagaggaaggtggcggccgctggatccaacgggctgatggaggacccaatgaaagtctacaaggacaggcagtttatgaacgtgtggaccgaccacgagaaggaaatcttcaaggataagttcatccagcatcccaaaaatttcggcctgatcgccagctacctggagaggaagtccgtgcctgactgcgtcctgtactattacctcacaaagaaaaacgaaaattacaaa

SEQ ID NO: 178 - protein, 220 aa, Artificial Sequence
  source: /note="Description of Artificial Sequence: Synthetic polypeptide"
MSKTIVLSVGEATRTLTEIQSTADRQIFEEKVGPLVGRLRLTASLRQNGAKTAYRVNLKLDQADVVDSGLPKVRYTQVWSHDVTIVANSTEASRKSLYDLTKSLVATSQVEDLVVNLVPLGRSAGGGGSGGGGSGGGGSGPKKKRKVAAAGSNGLMEDPMKVYKDRQFMNVWTDHEKEIFKDKFIQHPKNFGLIASYLERKSVPDCVLYYYLTKKNENYK

SEQ ID NO: 179 - DNA, 1482 bp, Artificial Sequence
  source: /note="Description of Artificial Sequence: Synthetic polynucleotide"
atggcttcaaactttactcagttcgtgctcgtggacaatggtgggacaggggatgtgacagtggctccttctaatttcgctaatggggtggcagagtggatcagctccaactcacggagccaggcctacaaggtgacatgcagcgtcaggcagtctagtgcccagaagagaaagtataccatcaaggtggaggtccccaaagtggctacccagacagtgggcggagtcgaactgcctgtcgccgcttggaggtcctacctgaacatggagctcactatcccaattttcgctaccaattctgactgtgaactcatcgtgaaggcaatgcaggggctcctcaaagacggtaatcctatcccttccgccatcgccgctaactcaggtatctacagcgctggaggaggtggaagcggaggaggaggaagcggaggaggaggtagcggacctaagaaaaagaggaaggtggcggccgctggatccaacggcgcgattggtggggatttgctgcttaactttcccgacatgtccgtgttggaacgtcagcgcgcacatttgaagtatcttaaccccaccttcgactccccgttggccgggttctttgcggactcatctatgattacgggaggggaaatggacagctacctctcaacggccggattgaatcttccgatgatgtatggagaaaccactgtagaaggcgactcgcgactctcgatttcgcctgaaacgacgctgggaacagggaacttcaagaaacggaaattcgacacggagacaaaagattgcaacgaaaagaagaagaaaatgaccatgaatcgcgatgatctggtagaggagggagaggaggaaaagtcgaagattactgaacagaacaatgggtctaccaaaagtatcaaaaagatgaagcacaaagctaagaaagaagagaacaatttcagcaatgacagcagtaaagtcacaaaagaactggagaaaacggattacattcacgtgagggcgcgacgagggcaggctacagattcacattcaattgcggagagagtacggagagagaaaatctcagaaaggatgaagttcctccaagaccttgtgccaggttgtgacaagatcacaggcaaagcaggaatgctggatgagatcatcaactacgtccaatcgttgcaaagacaaattgagtttctctcgatgaaactggccatcgtgaatcctagaccggatttcgacatggatgacatctttgcgaaagaagtggcatccactcccatgacggttgtgccctcaccggagatggtcttgtctggttacagccacgaaatggtgcattcgggttattcaagcgagatggtcaattcgggataccttcacgtcaatcccatgcagcaggtgaatacttccagtgatccactctcctgctttaacaacggcgaggccccttcgatgtgggactcccacgtacagaatctctatggaaatctcggagtc

SEQ ID NO: 180 - protein, 494 aa, Artificial Sequence
  source: /note="Description of Artificial Sequence: Synthetic polypeptide"
MASNFTQFVLVDNGGTGDVTVAPSNFANGVAEWISSNSRSQAYKVTCSVRQSSAQKRKYTIKVEVPKVATQTVGGVELPVAAWRSYLNMELTIPIFATNSDCELIVKAMQGLLKDGNPIPSAIAANSGIYSAGGGGSGGGGSGGGGSGPKKKRKVAAAGSNGAIGGDLLLNFPDMSVLERQRAHLKYLNPTFDSPLAGFFADSSMITGGEMDSYLSTAGLNLPMMYGETTVEGDSRLSISPETTLGTGNFKKRKFDTETKDCNEKKKKMTMNRDDLVEEGEEEKSKITEQNNGSTKSIKKMKHKAKKEENNFSNDSSKVTKELEKTDYIHVRARRGQATDSHSIAERVRREKISERMKFLQDLVPGCDKITGKAGMLDEIINYVQSLQRQIEFLSMKLAIVNPRPDFDMDDIFAKEVASTPMTVVPSPEMVLSGYSHEMVHSGYSSEMVNSGYLHVNPMQQVNTSSDPLSCFNNGEAPSMWDSHVQNLYGNLGV

SEQ ID NO: 181 - DNA, 3960 bp, Artificial Sequence
  source: /note="Description of Artificial Sequence: Synthetic polynucleotide"
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaacggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaacagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgct

SEQ ID NO: 182 - protein, 1320 aa, Artificial Sequence
  source: /note="Description of Artificial Sequence: Synthetic polypeptide"
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNGRADALDDFDLDMLGSDALDDFDLDMLGSDALDDFDLDMLGSDALDDFDLDMLINRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVAAA

SEQ ID NO: 183 - DNA, 4050 bp, Artificial Sequence
  source: /note="Description of Artificial Sequence: Synthetic polynucleotide"
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaacggcgggggaggctccggtggtgggggcagcggaggggggggcagcggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaacggcgggggaggctccggtggtgggggcagcggaggggggggcagcagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgct

SEQ ID NO: 184 - protein, 1350 aa, Artificial Sequence
  source: /note="Description of Artificial Sequence: Synthetic polypeptide"
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNGGGGSGGGGSGGGGSGRADALDDFDLDMLGSDALDDFDLDMLGSDALDDFDLDMLGSDALDDFDLDMLINGGGGSGGGGSGGGGSRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVAAA

SEQ ID NO: 185 - DNA, 4347 bp, Artificial Sequence
  source: /note="Description of Artificial Sequence: Synthetic polynucleotide"
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaacccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcagagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgct

SEQ ID NO: 186 - protein, 1449 aa, Artificial Sequence
  source: /note="Description of Artificial Sequence: Synthetic polypeptide"
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPSGQISNQALALAPSSAPVLAQTMVPSSAMVPLAQPPAPAPVLTPGPPQSLSAPVPKSTQAGEGTLSEALLHLQFDADEDLGALLGNSTDPGVFTDLASVDNSEFQQLLNQGVSMSHSTAEPMLMEYPEAITRLVTGSQRPPDPAPTPLGTSGLPNGLSGDEDFSSIADMDFSALLSQISSSGQRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVAAA

SEQ ID NO: 187 - DNA, 4437 bp, Artificial Sequence
  source: /note="Description of Artificial Sequence: Synthetic polynucleotide"
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaacggcgggggaggctccggtggtgggggcagcggaggggggggcagcccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcagggcgggggaggctccggtggtgggggcagcggaggggggggcagcagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgct

SEQ ID NO: 188 - protein, 1479 aa, Artificial Sequence
  source: /note="Description of Artificial Sequence: Synthetic polypeptide"
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNGGGGSGGGGSGGGGSPSGQISNQALALAPSSAPVLAQTMVPSSAMVPLAQPPAPAPVLTPGPPQSLSAPVPKSTQAGEGTLSEALLHLQFDADEDLGALLGNSTDPGVFTDLASVDNSEFQQLLNQGVSMSHSTAEPMLMEYPEAITRLVTGSQRPPDPAPTPLGTSGLPNGLSGDEDFSSIADMDFSALLSQISSSGQGGGGSGGGGSGGGGSRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVAAA

SEQ ID NO: 189 - DNA, 4068 bp, Artificial Sequence
  source: /note="Description of Artificial Sequence: Synthetic polynucleotide"
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagggcgggggaggctccggtggtgggggcagcggaggggggggcagcggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaacggcgggggaggctccggtggtgggggcagcggaggggggggcagcaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgct

SEQ ID NO: 190 - protein, 1356 aa, Artificial Sequence
  source: /note="Description of Artificial Sequence: Synthetic polypeptide"
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKGGGGSGGGGSGGGGSGRADALDDFDLDMLGSDALDDFDLDMLGSDALDDFDLDMLGSDALDDFDLDMLINGGGGSGGGGSGGGGSTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVAAA

SEQ ID NO: 191 - DNA, 4163 bp, Artificial Sequence
  source: /note="Description of Artificial Sequence: Synthetic polynucleotide"
aagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaaggggggtggtggaagtggcggtggcggctccggaggaggaggaagcggcggcggtggtagtggcggcggcggaagcggaggcggcggctccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaacgggggtggtggaagtggcggtggcggctccggaggaggaggaagcggcggcggtggtagtggcggcggcggaagcggaggcggcggctccaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgctgctagcggcag

SEQ ID NO: 192 - protein, 1387 aa, Artificial Sequence
  source: /note="Description of Artificial Sequence: Synthetic polypeptide"
KKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKGGGGSGGGGSGGGGSGGGGSGGGGSGGGGSGRADALDDFDLDMLGSDALDDFDLDMLGSDALDDFDLDMLGSDALDDFDLDMLINGGGGSGGGGSGGGGSGGGGSGGGGSGGGGSTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVAAAASG

SEQ ID NO: 193 - DNA, 4368 bp, Artificial Sequence
  source: /note="Description of Artificial Sequence: Synthetic polynucleotide"
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagggcgggggaggctccggtggtgggggcagcggaggggggggcagcccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcagggcgggggaggctccggtggtgggggcagcggaggggggggcagcaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgac

SEQ ID NO: 194 - protein, 1456 aa, Artificial Sequence
  source: /note="Description of Artificial Sequence: Synthetic polypeptide"
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKGGGGSGGGGSGGGGSPSGQISNQALALAPSSAPVLAQTMVPSSAMVPLAQPPAPAPVLTPGPPQSLSAPVPKSTQAGEGTLSEALLHLQFDADEDLGALLGNSTDPGVFTDLASVDNSEFQQLLNQGVSMSHSTAEPMLMEYPEAITRLVTGSQRPPDPAPTPLGTSGLPNGLSGDEDFSSIADMDFSALLSQISSSGQGGGGSGGGGSGGGGSTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 195 - DNA, 4536 bp, Artificial Sequence
  source: /note="Description of Artificial Sequence: Synthetic polynucleotide"
ggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaaggggggtggtggaagtggcggtggcggctccggaggaggaggaagcggcggcggtggtagtggcggcggcggaagcggaggcggcggctccccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcaggggggtggtggaagtggcggtggcggctccggaggaggaggaagcggcggcggtggtagtggcggcggcggaagcggaggcggcggctccaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggc

SEQ ID NO: 196 - protein, 1486 aa, Artificial Sequence
  source: /note="Description of Artificial Sequence: Synthetic polypeptide"
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKGGGGSGGGGSGGGGSGGGGSGGGGSGGGGSPSGQISNQALALAPSSAPVLAQTMVPSSAMVPLAQPPAPAPVLTPGPPQSLSAPVPKSTQAGEGTLSEALLHLQFDADEDLGALLGNSTDPGVFTDLASVDNSEFQQLLNQGVSMSHSTAEPMLMEYPEAITRLVTGSQRPPDPAPTPLGTSGLPNGLSGDEDFSSIADMDFSALLSQISSSGQGGGGSGGGGSGGGGSGGGGSGGGGSGGGGSTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 197 - DNA, 4380 bp, Artificial Sequence
  source: /note="Description of Artificial Sequence: Synthetic polynucleotide"
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaggaggggggggcagcggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaacggcgggggaggctccatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgct

SEQ ID NO: 198 - protein, 1460 aa, Artificial Sequence
  source: /note="Description of Artificial Sequence: Synthetic polypeptide"
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGGGGGSGRADALDDFDLDMLGSDALDDFDLDMLGSDALDDFDLDMLGSDALDDFDLDMLINGGGGSMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVAAA

SEQ ID NO: 199 - DNA, 4385 bp, Artificial Sequence
  source: /note="Description of Artificial Sequence: Synthetic polynucleotide"
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaggaggggggggcagcggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaacggcgggggaggctccatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgctgctag

SEQ ID NO: 200 - protein, 1461 aa, Artificial Sequence
  source: /note="Description of Artificial Sequence: Synthetic polypeptide"
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGGGGGSGRADALDDFDLDMLGSDALDDFDLDMLGSDALDDFDLDMLGSDALDDFDLDMLINGGGGSMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVAAAA

SEQ ID NO: 201 - DNA, 4768 bp, Artificial Sequence
  source: /note="Description of Artificial Sequence: Synthetic polynucleotide"
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaggagggggaggcagcccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcagggaggggggggcagcatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgctg

SEQ ID NO: 202 - protein, 1589 aa, Artificial Sequence
  source: /note="Description of Artificial Sequence: Synthetic polypeptide"
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGGGGGSPSGQISNQALALAPSSAPVLAQTMVPSSAMVPLAQPPAPAPVLTPGPPQSLSAPVPKSTQAGEGTLSEALLHLQFDADEDLGALLGNSTDPGVFTDLASVDNSEFQQLLNQGVSMSHSTAEPMLMEYPEAITRLVTGSQRPPDPAPTPLGTSGLPNGLSGDEDFSSIADMDFSALLSQISSSGQGGGGSMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVAAA

SEQ ID NO: 203 - DNA, 4852 bp, Artificial Sequence
  source: /note="Description of Artificial Sequence: Synthetic polynucleotide"
ggccaccatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaggcgggggaggctccggtggtgggggcagcggaggggggggcagcccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcagggcgggggaggctccggtggtgggggcagcggaggggggggcagcatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgctgctagcggcagtgga

SEQ ID NO: 204 - protein, 1613 aa, Artificial Sequence
  source: /note="Description of Artificial Sequence: Synthetic polypeptide"
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGGGGGSGGGGSGGGGSPSGQISNQALALAPSSAPVLAQTMVPSSAMVPLAQPPAPAPVLTPGPPQSLSAPVPKSTQAGEGTLSEALLHLQFDADEDLGALLGNSTDPGVFTDLASVDNSEFQQLLNQGVSMSHSTAEPMLMEYPEAITRLVTGSQRPPDPAPTPLGTSGLPNGLSGDEDFSSIADMDFSALLSQISSSGQGGGGSGGGGSGGGGSMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVAAAASGS

SEQ ID NO: 205 - DNA, 4374 bp, Artificial Sequence
  source: /note="Description of Artificial Sequence: Synthetic polynucleotide"
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcggagggggaggcagcggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaacggcgggggaggctccgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcg

SEQ ID NO: 206 - protein, 1458 aa, Artificial Sequence
  source: /note="Description of Artificial Sequence: Synthetic polypeptide"
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFGGGGSGRADALDDFDLDMLGSDALDDFDLDMLGSDALDDFDLDMLGSDALDDFDLDMLINGGGGSDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVA

SEQ ID NO: 207 - DNA, 4435 bp, Artificial Sequence
  source: /note="Description of Artificial Sequence: Synthetic polynucleotide"
cagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcggcgggggaggctccggtggtgggggcagcggaggggggggcagcggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaacggcgggggaggctccggtggtgggggcagcggaggggggggcagcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgctgctagc

SEQ ID NO: 208 - protein, 1452 aa, Artificial Sequence
  source: /note="Description of Artificial Sequence: Synthetic polypeptide"
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFGGGGSGGGGSGGGGSGRADALDDFDLDMLGSDALDDFDLDMLGSDALDDFDLDMLGSDALDDFDLDMLINGGGGSGGGGSGGGGSDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 209 - DNA, 4764 bp, Artificial Sequence
  source: /note="Description of Artificial Sequence: Synthetic polynucleotide"
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcggagggggaggcagcccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcagggaggggggggcagcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggcc

SEQ ID NO: 210 - protein, 1588 aa, Artificial Sequence
  source: /note="Description of Artificial Sequence: Synthetic polypeptide"
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFGGGGSPSGQISNQALALAPSSAPVLAQTMVPSSAMVPLAQPPAPAPVLTPGPPQSLSAPVPKSTQAGEGTLSEALLHLQFDADEDLGALLGNSTDPGVFTDLASVDNSEFQQLLNQGVSMSHSTAEPMLMEYPEAITRLVTGSQRPPDPAPTPLGTSGLPNGLSGDEDFSSIADMDFSALLSQISSSGQGGGGSDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVAA

SEQ ID NO: 211 - DNA, 4833 bp, Artificial Sequence
  source: /note="Description of Artificial Sequence: Synthetic polynucleotide"
accatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcggcgggggaggctccggtggtgggggcagcggaggggggggcagcccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcagggcgggggaggctccggtggtgggggcagcggaggggggggcagcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgct

SEQ ID NO: 212 - protein, 1611 aa, Artificial Sequence
  source: /note="Description of Artificial Sequence: Synthetic polypeptide"
TMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFGGGGSGGGGSGGGGSPSGQISNQALALAPSSAPVLAQTMVPSSAMVPLAQPPAPAPVLTPGPPQSLSAPVPKSTQAGEGTLSEALLHLQFDADEDLGALLGNSTDPGVFTDLASVDNSEFQQLLNQGVSMSHSTAEPMLMEYPEAITRLVTGSQRPPDPAPTPLGTSGLPNGLSGDEDFSSIADMDFSALLSQISSSGQGGGGSGGGGSGGGGSDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVAAA

SEQ ID NO: 213 - DNA, 4380 bp, Artificial Sequence
  source: /note="Description of Artificial Sequence: Synthetic polynucleotide"
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagggagggggaggcagcggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaacggcgggggaggctcctccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgct

SEQ ID NO: 214 - protein, 1460 aa, Artificial Sequence
  source: /note="Description of Artificial Sequence: Synthetic polypeptide"
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKGGGGSGRADALDDFDLDMLGSDALDDFDLDMLGSDALDDFDLDMLGSDALDDFDLDMLINGGGGSSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVAAA

SEQ ID NO: 215 - DNA, 4445 bp, Artificial Sequence
  source: /note="Description of Artificial Sequence: Synthetic polynucleotide"
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagggcgggggaggctccggtggtgggggcagcggaggggggggcagcggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaacggcgggggaggctccggtggtgggggcagcggaggggggggcagctccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgctgctag

SEQ ID NO: 216 - protein, 1481 aa, Artificial Sequence
  source: /note="Description of Artificial Sequence: Synthetic polypeptide"
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKGGGGSGGGGSGGGGSGRADALDDFDLDMLGSDALDDFDLDMLGSDALDDFDLDMLGSDALDDFDLDMLINGGGGSGGGGSGGGGSSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVAAAA

SEQ ID NO: 217 - DNA, 4767 bp, Artificial Sequence
  source: /note="Description of Artificial Sequence: Synthetic polynucleotide"
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagggagggggaggcagcccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcagggaggggggggcagctccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgct

SEQ ID NO: 218 - protein, 1589 aa, Artificial Sequence
  source: /note="Description of Artificial Sequence: Synthetic polypeptide"
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKGGGGSPSGQISNQALALAPSSAPVLAQTMVPSSAMVPLAQPPAPAPVLTPGPPQSLSAPVPKSTQAGEGTLSEALLHLQFDADEDLGALLGNSTDPGVFTDLASVDNSEFQQLLNQGVSMSHSTAEPMLMEYPEAITRLVTGSQRPPDPAPTPLGTSGLPNGLSGDEDFSSIADMDFSALLSQISSSGQGGGGSSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVAAA

SEQ ID NO: 219 - DNA, 4830 bp, Artificial Sequence
  source: /note="Description of Artificial Sequence: Synthetic polynucleotide"
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagggcgggggaggctccggtggtgggggcagcggaggggggggcagcccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcagggcgggggaggctccggtggtgggggcagcggaggggggggcagctccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgct

SEQ ID NO: 220 - protein, 1610 aa, Artificial Sequence
  source: /note="Description of Artificial Sequence: Synthetic polypeptide"
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKGGGGSGGGGSGGGGSPSGQISNQALALAPSSAPVLAQTMVPSSAMVPLAQPPAPAPVLTPGPPQSLSAPVPKSTQAGEGTLSEALLHLQFDADEDLGALLGNSTDPGVFTDLASVDNSEFQQLLNQGVSMSHSTAEPMLMEYPEAITRLVTGSQRPPDPAPTPLGTSGLPNGLSGDEDFSSIADMDFSALLSQISSSGQGGGGSGGGGSGGGGSSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVAAA

SEQ ID NO: 221 - DNA, 4359 bp, Artificial Sequence
  source: /note="Description of Artificial Sequence: Synthetic polynucleotide"
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccacatcgtgcctcagagctttctgaaggacgactccatcgacaacaaggtgctgaccagaagcgacaaggcccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgctggatccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaac

SEQ ID NO: 222 - protein, 1453 aa, Artificial Sequence
  source: /note="Description of Artificial Sequence: Synthetic polypeptide"
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSAGGGGSGGGGSGGGGSGPKKKRKVAAAGSGRADALDDFDLDMLGSDALDDFDLDMLGSDALDDFDLDMLGSDALDDFDLDMLIN

SEQ ID NO: 223 - DNA, 109 bp, Artificial Sequence
  source: /note="Description of Artificial Sequence: Synthetic primer"
  modified_base (59)..(76): a, c, t, g, unknown or other
  Variation (67)..(76): /replace=" "
  misc_feature (67)..(76): /note="This region may encompass 1-10 nucleotides, wherein some or all positions may be absent"
  misc_feature (1)..(109): /note="Variant nucleotides given in the sequence have no preference with respect to those in the annotations for variant positions"
aatgatacggcgaccaccgagatctacactctttccctacacgacgctcttccgatctnnnnnnnnnnnnnnnnnngctttatatatcttgtggaaaggacgaaacacc

SEQ ID NO: 224 - DNA, 91 bp, Artificial Sequence
  source: /note="Description of Artificial Sequence: Synthetic primer"
  modified_base (25)..(32): a, c, t, g, unknown or other
caagcagaagacggcatacgagatnnnnnnnngtgactggagttcagacgtgtgctcttccgatctgccaagttgataacggactagcctt

SEQ ID NO: 225 - DNA, 102 bp, Artificial Sequence
  source: /note="Description of Artificial Sequence: Synthetic polynucleotide"
gttttagagctatgctgttttgaatggtcccaaaacggaagggcctgagtccgagcagaagaagaagttttagagctatgctgttttgaatggtcccaaaac

SEQ ID NO: 226 - DNA, 100 bp, Homo sapiens
cggaggacaaagtacaaacggcagaagctggaggaggaagggcctgagtccgagcagaagaagaagggctcccatcacatcaaccggtggcgcattgcca

SEQ ID NO: 227 - DNA, 50 bp, Homo sapiens
agctggaggaggaagggcctgagtccgagcagaagaagaagggctcccac

SEQ ID NO: 228 - RNA, 30 nt, Artificial Sequence
  source: /note="Description of Artificial Sequence: Synthetic oligonucleotide"
gaguccgagcagaagaagaaguuuuagagc

SEQ ID NO: 229 - DNA, 49 bp, Artificial Sequence
  source: /note="Description of Artificial Sequence: Synthetic oligonucleotide"
agctggaggaggaagggcctgagtccgagcagaagagaagggctcccat

SEQ ID NO: 230 - DNA, 53 bp, Homo sapiens
ctggaggaggaagggcctgagtccgagcagaagaagaagggctcccatcacat

SEQ ID NO: 231 - DNA, 52 bp, Homo sapiens
ctggaggaggaagggcctgagtccgagcagaagagaagggctcccatcacat

SEQ ID NO: 232 - DNA, 54 bp, Homo sapiens
ctggaggaggaagggcctgagtccgagcagaagaaagaagggctcccatcacat

SEQ ID NO: 233 - DNA, 50 bp, Homo sapiens
ctggaggaggaagggcctgagtccgagcagaagaagggctcccatcacat

SEQ ID NO: 234 - DNA, 47 bp, Homo sapiens
ctggaggaggaagggcctgagcccgagcagaagggctcccatcacat

SEQ ID NO: 235 - DNA, 48 bp, Homo sapiens
ctggaggaggaagggcctgagtccgagcagaagaagaagggctcccat

SEQ ID NO: 236 - RNA, 20 nt, Artificial Sequence
  source: /note="Description of Artificial Sequence: Synthetic oligonucleotide"
gaguccgagcagaagaagau

SEQ ID NO: 237 - RNA, 20 nt, Artificial Sequence
  source: /note="Description of Artificial Sequence: Synthetic oligonucleotide"
gaguccgagcagaagaagua

SEQ ID NO: 238 - RNA, 20 nt, Artificial Sequence
  source: /note="Description of Artificial Sequence: Synthetic oligonucleotide"
gaguccgagcagaagaacaa

SEQ ID NO: 239 - RNA, 20 nt, Artificial Sequence
  source: /note="Description of Artificial Sequence: Synthetic oligonucleotide"
gaguccgagcagaagaugaa

SEQ ID NO: 240 - RNA, 20 nt, Artificial Sequence
  source: /note="Description of Artificial Sequence: Synthetic oligonucleotide"
gaguccgagcagaaguagaa

SEQ ID NO: 241 - RNA, 20 nt, Artificial Sequence
  source: /note="Description of Artificial Sequence: Synthetic oligonucleotide"
gaguccgagcagaugaagaa

SEQ ID NO: 242 - RNA, 20 nt, Artificial Sequence
  source: /note="Description of Artificial Sequence: Synthetic oligonucleotide"
gaguccgagcacaagaagaa

SEQ ID NO: 243 - RNA, 20 nt, Artificial Sequence
  source: /note="Description of Artificial Sequence: Synthetic oligonucleotide"
gaguccgaggagaagaagaa

SEQ ID NO: 244 - RNA, 20 nt, Artificial Sequence
  source: /note="Description of Artificial Sequence: Synthetic oligonucleotide"
gaguccgugcagaagaagaa

SEQ ID NO: 245 - RNA, 20 nt, Artificial Sequence
  source: /note="Description of Artificial Sequence: Synthetic oligonucleotide"
gagucggagcagaagaagaa

SEQ ID NO: 246 - RNA, 20 nt, Artificial Sequence
  source: /note="Description of Artificial Sequence: Synthetic oligonucleotide"
gagaccgagcagaagaagaa

SEQ ID NO: 247 - DNA, 24 bp, Artificial Sequence
  source: /note="Description of Artificial Sequence: Synthetic oligonucleotide"
aatgacaagcttgctagcggtggg

SEQ ID NO: 248 - DNA, 39 bp, Artificial Sequence
  source: /note="Description of Artificial Sequence: Synthetic oligonucleotide"
aaaacggaagggcctgagtccgagcagaagaagaagttt

SEQ ID NO: 249 - DNA, 39 bp, Artificial Sequence
  source: /note="Description of Artificial Sequence: Synthetic oligonucleotide"
aaacaggggccgagattgggtgttcagggcagaggtttt

SEQ ID NO: 250 - DNA, 38 bp, Artificial Sequence
  source: /note="Description of Artificial Sequence: Synthetic oligonucleotide"
aaaacggaagggcctgagtccgagcagaagaagaagtt

SEQ ID NO: 251 - DNA, 40 bp, Artificial Sequence
  source: /note="Description of Artificial Sequence: Synthetic oligonucleotide"
aacggagggaggggcacagatgagaaactcagggttttag

SEQ ID NO: 252 - DNA, 38 bp, Homo sapiens
agcccttcttcttctgctcggactcaggcccttcctcc

SEQ ID NO: 253 - DNA, 40 bp, Homo sapiens
cagggagggaggggcacagatgagaaactcaggaggcccc

SEQ ID NO: 254 - DNA, 80 bp, Artificial Sequence
  source: /note="Description of Artificial Sequence: Synthetic oligonucleotide"
ggcaatgcgccaccggttgatgtgatgggagcccttctaggaggcccccagagcagccactggggcctcaacactcaggc

SEQ ID NO: 255 - DNA, 33 bp, Homo sapiens
catcgatgtcctccccattggcctgcttcgtgg

SEQ ID NO: 256 - DNA, 33 bp, Homo sapiens
ttcgtggcaatgcgccaccggttgatgtgatgg

SEQ ID NO: 257 - DNA, 33 bp, Homo sapiens
tcgtggcaatgcgccaccggttgatgtgatggg

SEQ ID NO: 258 - DNA, 33 bp, Homo sapiens
tccagcttctgccgtttgtactttgtcctccgg

SEQ ID NO: 259 - DNA, 33 bp, Homo sapiens
ggagggaggggcacagatgagaaactcaggagg

SEQ ID NO: 260 - DNA, 33 bp, Homo sapiens
aggggccgagattgggtgttcagggcagagagg

SEQ ID NO: 261 - DNA, 33 bp, Mus musculus
caagcactgagtgccattagctaaatgcatagg

SEQ ID NO: 262 - DNA, 33 bp, Mus musculus
aatgcatagggtaccacccacaggtgccagggg

SEQ ID NO: 263 - DNA, 33 bp, Mus musculus
acacacatgggaaagcctctgggccaggaaagg

SEQ ID NO: 264 - DNA, 37 bp, Homo sapiens
ggaggaggtagtatacagaaacacagagaagtagaat

SEQ ID NO: 265 - DNA, 37 bp, Homo sapiens
agaatgtagaggagtcacagaaactcagcactagaaa

SEQ ID NO: 266 - DNA, 98 bp, Artificial Sequence
  source: /note="Description of Artificial Sequence: Synthetic oligonucleotide"
ggacgaaacaccggaaccattcaaaacagcatagcaagttaaaataaggctagtccgttatcaacttgaaaaagtggcaccgagtcggtgcttttttt

SEQ ID NO: 267 - DNA, 186 bp, Artificial Sequence
  source: /note="Description of Artificial Sequence: Synthetic polynucleotide"
ggacgaaacaccggtagtattaagtattgttttatggctgataaatttctttgaatttctccttgattatttgttataaaagttataaaataatcttgttggaaccattcaaaacagcatagcaagttaaaataaggctagtccgttatcaacttgaaaaagtggcaccgagtcggtgcttttttt

SEQ ID NO: 268 - DNA, 95 bp, Artificial Sequence
  source: /note="Description of Artificial Sequence: Synthetic oligonucleotide"
gggttttagagctatgctgttttgaatggtcccaaaacgggtcttcgagaagacgttttagagctatgctgttttgaatggtcccaaaacttttt

SEQ ID NO: 269 - DNA, 36 bp, Artificial Sequence
  source: /note="Description of Artificial Sequence: Synthetic oligonucleotide"
  modified_base (5)..(34): a, c, t, g, unknown or other
aaacnnnnnnnnnnnnnnnnnnnnnnnnnnnnnngt

SEQ ID NO: 270 - DNA, 36 bp, Artificial Sequence
  source: /note="Description of Artificial Sequence: Synthetic oligonucleotide"
  modified_base (7)..(36): a, c, t, g, unknown or other
taaaacnnnnnnnnnnnnnnnnnnnnnnnnnnnnnn

SEQ ID NO: 271 - DNA, 84 bp, Artificial Sequence
  source: /note="Description of Artificial Sequence: Synthetic oligonucleotide"
gtggaaaggacgaaacaccgggtcttcgagaagacctgttttagagctagaaatagcaagttaaaataaggctagtccgttttt

SEQ ID NO: 272 - RNA, 46 nt, Artificial Sequence
  source: /note="Description of Artificial Sequence: Synthetic oligonucleotide"
  modified_base (1)..(19): a, c, u, g, unknown or other
nnnnnnnnnnnnnnnnnnnguuauuguacucucaagauuuauuuuu

SEQ ID NO: 273 - RNA, 91 nt, Artificial Sequence
  source: /note="Description of Artificial Sequence: Synthetic oligonucleotide"
guuacuuaaaucuugcagaagcuacaaagauaaggcuucaugccgaaaucaacacccugucauuuuauggcaggguguuuucguuauuuaa

SEQ ID NO: 274 - DNA, 70 bp, Homo sapiens
ttttctagtgctgagtttctgtgactcctctacattctacttctctgtgtttctgtatactacctcctcc

SEQ ID NO: 275 - DNA, 122 bp, Homo sapiens
ggaggaagggcctgagtccgagcagaagaagaagggctcccatcacatcaaccggtggcgcattgccacgaagcaggccaatggggaggacatcgatgtcacctccaatgactagggtgggc

SEQ ID NO: 276 - RNA, 48 nt, Artificial Sequence
  source: /note="Description of Artificial Sequence: Synthetic oligonucleotide"
  modified_base (3)..(32): a, c, u, g, unknown or other
acnnnnnnnnnnnnnnnnnnnnnnnnnnnnnnguuuuagagcuaugcu

SEQ ID NO: 277 - DNA, 67 bp, Artificial Sequence
  source: /note="Description of Artificial Sequence: Synthetic oligonucleotide"
  source: /note="Description of Combined DNA/RNA Molecule: Synthetic oligonucleotide"
agcauagcaaguuaaaauaaggctaguccguuaucaacuugaaaaaguggcaccgagucggugcuuu

SEQ ID NO: 278 - RNA, 62 nt, Artificial Sequence
  source: /note="Description of Artificial Sequence: Synthetic oligonucleotide"
  modified_base (1)..(20): a, c, u, g, unknown or other
nnnnnnnnnnnnnnnnnnnnguuuuagagcuagaaauagcaaguuaaaauaaggcuaguccg

SEQ ID NO: 279 - DNA, 73 bp, Artificial Sequence
  source: /note="Description of Artificial Sequence: Synthetic oligonucleotide"
tgaatggtcccaaaacggaagggcctgagtccgagcagaagaagaagttttagagctatgctgttttgaatgg

SEQ ID NO: 280 - DNA, 69 bp, Homo sapiens
ctggtcttccacctctctgccctgaacacccaatctcggcccctctcgccaccctcctgcatttctgtt

SEQ ID NO: 281 - DNA, 138 bp, Mus musculus
acccaagcactgagtgccattagctaaatgcatagggtaccacccacaggtgccaggggcctttcccaaagttcccagccccttctccaacctttcctggcccagaggctttcccatgtgtgtggctggaccctttga

SEQ ID NO: 282 - DNA, 21 bp, Artificial Sequence
  source: /note="Description of Artificial Sequence: Synthetic primer"
aaaaccacccttctctctggc

SEQ ID NO: 283 - DNA, 21 bp, Artificial Sequence
  source: /note="Description of Artificial Sequence: Synthetic primer"
ggagattggagacacggagag

SEQ ID NO: 284 - DNA, 20 bp, Artificial Sequence
  source: /note="Description of Artificial Sequence: Synthetic primer"
ctggaaagccaatgcctgac

SEQ ID NO: 285 - DNA, 20 bp, Artificial Sequence
  source: /note="Description of Artificial Sequence: Synthetic primer"
ggcagcaaactccttgtcct

SEQ ID NO: 286 - DNA, 20 bp, Artificial Sequence
  source: /note="Description of Artificial Sequence: Synthetic primer"
gtgctttgcagaggcctacc

SEQ ID NO: 287 - DNA, 20 bp, Artificial Sequence
  source: /note="Description of Artificial Sequence: Synthetic primer"
cctggagcgcatgcagtagt

SEQ ID NO: 288 - DNA, 22 bp, Artificial Sequence
  source: /note="Description of Artificial Sequence: Synthetic primer"
accttctgtgtttccaccattc

SEQ ID NO: 289 - DNA, 20 bp, Artificial Sequence
  source: /note="Description of Artificial Sequence: Synthetic primer"
ttggggagtgcacagacttc

SEQ ID NO: 290 - DNA, 30 bp, Artificial Sequence
  source: /note="Description of Artificial Sequence: Synthetic probe"
tagctctaaaacttcttcttctgctcggac

SEQ ID NO: 291 - DNA, 30 bp, Artificial Sequence
  source: /note="Description of Artificial Sequence: Synthetic probe"
ctagccttattttaacttgctatgctgttt

SEQ ID NO: 292 - RNA, 99 nt, Artificial Sequence
  source: /note="Description of Artificial Sequence: Synthetic oligonucleotide"
  modified_base (1)..(20): a, c, u, g, unknown or other
nnnnnnnnnnnnnnnnnnnnguuuuagagcuagaaauagcaaguuaaaauaaggcuaguccguuaucaacuugaaaaaguggcaccgagucggugcuuu

SEQ ID NO: 293 - DNA, 12 bp, Homo sapiens
tagcgggtaagc

SEQ ID NO: 294 - DNA, 12 bp, Homo sapiens
tcggtgacatgt

SEQ ID NO: 295 - DNA, 12 bp, Homo sapiens
actccccgtagg

SEQ ID NO: 296 - DNA, 12 bp, Homo sapiens
actgcgtgttaa

SEQ ID NO: 297 - DNA, 12 bp, Homo sapiens
acgtcgcctgat

SEQ ID NO: 298 - DNA, 12 bp, Homo sapiens
taggtcgaccag

SEQ ID NO: 299 - DNA, 12 bp, Homo sapiens
ggcgttaatgat

SEQ ID NO: 300 - DNA, 12 bp, Homo sapiens
tgtcgcatgtta

SEQ ID NO: 301 - DNA, 12 bp, Homo sapiens
atggaaacgcat

SEQ ID NO: 302 - DNA, 12 bp, Homo sapiens
gccgaattcctc

SEQ ID NO: 303 - DNA, 12 bp, Homo sapiens
gcatggtacgga

SEQ ID NO: 304 - DNA, 12 bp, Homo sapiens
cggtactcttac

SEQ ID NO: 305 - DNA, 12 bp, Homo sapiens
gcctgtgccgta

SEQ ID NO: 306 - DNA, 12 bp, Homo sapiens
tacggtaagtcg

SEQ ID NO: 307 - DNA, 12 bp, Homo sapiens
cacgaaattacc

SEQ ID NO: 308 - DNA, 12 bp, Homo sapiens
aaccaagatacg

SEQ ID NO: 309 - DNA, 12 bp, Homo sapiens
gagtcgatacgc

SEQ ID NO: 310 - DNA, 12 bp, Homo sapiens
gtctcacgatcg

SEQ ID NO: 311 - DNA, 12 bp, Homo sapiens
tcgtcgggtgca

SEQ ID NO: 312 - DNA, 12 bp, Homo sapiens
actccgtagtga

SEQ ID NO: 313 - DNA, 12 bp, Homo sapiens
caggacgtccgt

SEQ ID NO: 314 - DNA, 12 bp, Homo sapiens
tcgtatccctac

SEQ ID NO: 315 - DNA, 12 bp, Homo sapiens
tttcaaggccgg

SEQ ID NO: 316 - DNA, 12 bp, Homo sapiens
cgccggtggaat

SEQ ID NO: 317 - DNA, 12 bp, Homo sapiens
gaacccgtccta

SEQ ID NO: 318 - DNA, 12 bp, Homo sapiens
gattcatcagcg

SEQ ID NO: 319 - DNA, 12 bp, Homo sapiens
acaccggtcttc

SEQ ID NO: 320 - DNA, 12 bp, Homo sapiens
atcgtgccctaa

SEQ ID NO: 321 - DNA, 12 bp, Homo sapiens
gcgtcaatgttc

SEQ ID NO: 322 - DNA, 12 bp, Homo sapiens
ctccgtatctcg

SEQ ID NO: 323 - DNA, 12 bp, Homo sapiens
ccgattccttcg

SEQ ID NO: 324 - DNA, 12 bp, Homo sapiens
tgcgcctccagt

SEQ ID NO: 325 - DNA, 12 bp, Homo sapiens
taacgtcggagc

SEQ ID NO: 326 - DNA, 12 bp, Homo sapiens
aaggtcgcccat

SEQ ID NO: 327 - DNA, 12 bp, Homo sapiens
gtcggggactat

SEQ ID NO: 328 - DNA, 12 bp, Homo sapiens
ttcgagcgattt

SEQ ID NO: 329 - DNA, 12 bp, Homo sapiens
tgagtcgtcgag

SEQ ID NO: 330 - DNA, 12 bp, Homo sapiens
tttacgcagagg

SEQ ID NO: 331 - DNA, 12 bp, Homo sapiens
aggaagtatcgc

SEQ ID NO: 332 - DNA, 12 bp, Homo sapiens
actcgataccat

SEQ ID NO: 333 - DNA, 12 bp, Homo sapiens
cgctacatagca

SEQ ID NO: 334 - DNA, 12 bp, Homo sapiens
ttcataaccggc

SEQ ID NO: 335 - DNA, 12 bp, Homo sapiens
ccaaacggttaa

SEQ ID NO: 336 - DNA, 12 bp, Homo sapiens
cgattccttcgt

SEQ ID NO: 337 - DNA, 12 bp, Homo sapiens
cgtcatgaataa

SEQ ID NO: 338 - DNA, 12 bp, Homo sapiens
agtggcgatgac

SEQ ID NO: 339 - DNA, 12 bp, Homo sapiens
cccctacggcac

SEQ ID NO: 340 - DNA, 12 bp, Homo sapiens
gccaacccgcac

SEQ ID NO: 341 - DNA, 12 bp, Homo sapiens
tgggacaccggt

SEQ ID NO: 342 - DNA, 12 bp, Homo sapiens
ttgactgcggcg

SEQ ID NO: 343 - DNA, 12 bp, Homo sapiens
actatgcgtagg

SEQ ID NO: 344 - DNA, 12 bp, Homo sapiens
tcacccaaagcg

SEQ ID NO: 345 - DNA, 12 bp, Homo sapiens
gcaggacgtccg

SEQ ID NO: 346 - DNA, 12 bp, Homo sapiens
acaccgaaaacg

SEQ ID NO: 347 - DNA, 12 bp, Homo sapiens
cggtgtattgag

SEQ ID NO: 348 - DNA, 12 bp, Homo sapiens
cacgaggtatgc

SEQ ID NO: 349 - DNA, 12 bp, Homo sapiens
taaagcgacccg

SEQ ID NO: 350 - DNA, 12 bp, Homo sapiens
cttagtcggcca

SEQ ID NO: 351 - DNA, 12 bp, Homo sapiens
cgaaaacgtggc

SEQ ID NO: 352 - DNA, 12 bp, Homo sapiens
cgtgccctgaac

SEQ ID NO: 353 - DNA, 12 bp, Homo sapiens
tttaccatcgaa

SEQ ID NO: 354 - DNA, 12 bp, Homo sapiens
cgtagccatgtt

SEQ ID NO: 355 - DNA, 12 bp, Homo sapiens
cccaaacggtta

SEQ ID NO: 356 - DNA, 12 bp, Homo sapiens
gcgttatcagaa

SEQ ID NO: 357 - DNA, 12 bp, Homo sapiens
tcgatggtaaac

SEQ ID NO: 358 - DNA, 12 bp, Homo sapiens
cgactttttgca

SEQ ID NO: 359 - DNA, 12 bp, Homo sapiens
tcgacgactcac

SEQ ID NO: 360 - DNA, 12 bp, Homo sapiens
acgcgtcagata

SEQ ID NO: 361 - DNA, 12 bp, Homo sapiens
cgtacggcacag

SEQ ID NO: 362 - DNA, 12 bp, Homo sapiens
ctatgccgtgca

SEQ ID NO: 363 - DNA, 12 bp, Homo sapiens
cgcgtcagatat

SEQ ID NO: 364 - DNA, 12 bp, Homo sapiens
aagatcggtagc

SEQ ID NO: 365 - DNA, 12 bp, Homo sapiens
cttcgcaaggag

SEQ ID NO: 366 - DNA, 12 bp, Homo sapiens
gtcgtggactac

SEQ ID NO: 367 - DNA, 12 bp, Homo sapiens
ggtcgtcatcaa

SEQ ID NO: 368 - DNA, 12 bp, Homo sapiens
gttaacagcgtg

SEQ ID NO: 369 - DNA, 12 bp, Homo sapiens
tagctaaccgtt

SEQ ID NO: 370 - DNA, 12 bp, Homo sapiens
agtaaaggcgct

SEQ ID NO: 371 - DNA, 12 bp, Homo sapiens
ggtaatttcgtg

SEQ ID NO: 372 - DNA, 15 bp, Homo sapiens
cagaagaagaagggc

SEQ ID NO: 373 - DNA, 51 bp, Homo sapiens
ccaatggggaggacatcgatgtcacctccaatgactagggtggtgggcaac

SEQ ID NO: 374 - DNA, 15 bp, Homo sapiens
ctctggccactccct

SEQ ID NO: 375 - DNA, 52 bp, Homo sapiens
acatcgatgtcacctccaatgacaagcttgctagcggtgggcaaccacaaac

SEQ ID NO: 376 - DNA, 25 bp, Artificial Sequence
  source: /note="Description of Artificial Sequence: Synthetic oligonucleotide"
  modified_base (6)..(25): a, c, t, g, unknown or other
caccgnnnnnnnnnnnnnnnnnnnn

SEQ ID NO: 377 - DNA, 25 bp, Artificial Sequence
  source: /note="Description of Artificial Sequence: Synthetic oligonucleotide"
  modified_base (5)..(24): a, c, t, g, unknown or other
aaacnnnnnnnnnnnnnnnnnnnnc

SEQ ID NO: 378 - DNA, 54 bp, Artificial Sequence
  source: /note="Description of Artificial Sequence: Synthetic oligonucleotide"
aacaccgggtcttcgagaagacctgttttagagctagaaatagcaagttaaaat

SEQ ID NO: 379 - DNA, 54 bp, Artificial Sequence
  source: /note="Description of Artificial Sequence: Synthetic oligonucleotide"
caaaacgggtcttcgagaagacgttttagagctatgctgttttgaatggtccca

SEQ ID NO: 380 - DNA, 24 bp, Artificial Sequence
  source: /note="Description of Artificial Sequence: Synthetic oligonucleotide"
  modified_base (6)..(24): a, c, t, g, unknown or other
caccgnnnnnnnnnnnnnnnnnnn

SEQ ID NO: 381 - DNA, 24 bp, Artificial Sequence
  source: /note="Description of Artificial Sequence: Synthetic oligonucleotide"
  modified_base (5)..(23): a, c, t, g, unknown or other
aaacnnnnnnnnnnnnnnnnnnnc

SEQ ID NO: 382 - DNA, 20 bp, Artificial Sequence
  source: /note="Description of Artificial Sequence: Synthetic oligonucleotide"
ggctccctgggttcaaagta

SEQ ID NO: 383 - DNA, 21 bp, Artificial Sequence
  source: /note="Description of Artificial Sequence: Synthetic oligonucleotide"
agaggggtctggatgtcgtaa

SEQ ID NO: 384 - RNA, 99 nt, Artificial Sequence; identical to SEQ ID NO: 292
  source: /note="Description of Artificial Sequence: Synthetic oligonucleotide"
  modified_base (1)..(20): a, c, u, g, unknown or other

SEQ ID NO: 385 - DNA, 20 bp, Artificial Sequence
  source: /note="Description of Artificial Sequence: Synthetic oligonucleotide"
gccaagcgcacctaatttcc

SEQ ID NO: 386 - RNA, 97 nt, Artificial Sequence
  source: /note="Description of Artificial Sequence: Synthetic oligonucleotide"
ggaaauuaggugcgcuuggcguuuuagagcuagaaauagcaaguuaaaauaaggcuaguccguuaucaacuugagaaaguggcaccgagucggugcu

SEQ ID NO: 387 - DNA, 81 bp, Artificial Sequence
  source: /note="Description of Artificial Sequence: Synthetic oligonucleotide"
gccccagagctagaaatagcaagttggggtaaggctagtccgttatcaacttgaaaaagtggcaccgagtcggtgcttttt

SEQ ID NO: 388 - DNA, 81 bp, Artificial Sequence
  source: /note="Description of Artificial Sequence: Synthetic oligonucleotide"
gttttagagcccgaaagggcaagttaaaataaggctagtccgttatcaacttgaaaaagtggcaccgagtcggtgcttttt

SEQ ID NO: 389 - DNA, 77 bp, Artificial Sequence
  source: /note="Description of Artificial Sequence: Synthetic oligonucleotide"
gttttagagcgaaagcaagttaaaataaggctagtccgttatcaacttgaaaaagtggcaccgagtcggtgcttttt

SEQ ID NO: 390 - DNA, 75 bp, Artificial Sequence
  source: /note="Description of Artificial Sequence: Synthetic oligonucleotide"
gttttagaggaaacaagttaaaataaggctagtccgttatcaacttgaaaaagtggcaccgagtcggtgcttttt

SEQ ID NO: 391 - DNA, 72 bp, Artificial Sequence
  source: /note="Description of Artificial Sequence: Synthetic oligonucleotide"
gttttagagacaagttaaaataaggctagtccgttatcaacttgaaaaagtggcaccgagtcggtgcttttt

SEQ ID NO: 392 - DNA, 79 bp, Artificial Sequence
  source: /note="Description of Artificial Sequence: Synthetic oligonucleotide"
gttttagagctagaaatagctttaaaataaggctagtccgttatcaacttgaaaaagtggcaccgagtcggtgcttttt

SEQ ID NO: 393 - DNA, 79 bp, Artificial Sequence
  source: /note="Description of Artificial Sequence: Synthetic oligonucleotide"
gttttagcgctagaaatagcgttaaaataaggctagtccgttatcaacttgaaaaagtggcaccgagtcggtgcttttt

SEQ ID NO: 394 - DNA, 81 bp, Artificial Sequence
  source: /note="Description of Artificial Sequence: Synthetic oligonucleotide"
gttttagcgctagaaatagcaagttaaaataaggctagtccgttatcaacttgaaaaagtggcaccgagtcggtgcttttt

SEQ ID NO: 395 - DNA, 81 bp, Artificial Sequence
  source: /note="Description of Artificial Sequence: Synthetic oligonucleotide"
gttttagtgctagaaatagcaagttaaaataaggctagtccgttatcaacttgaaaaagtggcaccgagtcggtgcttttt

SEQ ID NO: 396 - DNA, 81 bp, Artificial Sequence
  source: /note="Description of Artificial Sequence: Synthetic oligonucleotide"
gttttagggctagaaatagcaagttaaaataaggctagtccgttatcaacttgaaaaagtggcaccgagtcggtgcttttt

SEQ ID NO: 397 - DNA, 81 bp, Artificial Sequence
  source: /note="Description of Artificial Sequence: Synthetic oligonucleotide"
gttttagagctagaaatagcttgttaaaataaggctagtccgttatcaacttgaaaaagtggcaccgagtcggtgcttttt

SEQ ID NO: 398 - DNA, 81 bp, Artificial Sequence
  source: /note="Description of Artificial Sequence: Synthetic oligonucleotide"
gttttagagctagaaatagcaacttaaaataaggctagtccgttatcaacttgaaaaagtggcaccgagtcggtgcttttt

SEQ ID NO: 399 - DNA, 81 bp, Artificial Sequence
  source: /note="Description of Artificial Sequence: Synthetic oligonucleotide"
gttttagagctagaaatagcaaattaaaataaggctagtccgttatcaacttgaaaaagtggcaccgagtcggtgcttttt

SEQ ID NO: 400 - DNA, 81 bp, Artificial Sequence
  source: /note="Description of Artificial Sequence: Synthetic oligonucleotide"
gttttagagctagaaatagcaatttaaaataaggctagtccgttatcaacttgaaaaagtggcaccgagtcggtgcttttt

SEQ ID NO: 401 - DNA, 77 bp, Artificial Sequence
  source: /note="Description of Artificial Sequence: Synthetic oligonucleotide"
gttttagagctagaaatagcaagttaaaataaggctagtccgtaacttgaaaaagtggcaccgagtcggtgcttttt

SEQ ID NO: 402 - DNA, 81 bp, Artificial Sequence
  source: /note="Description of Artificial Sequence: Synthetic oligonucleotide"
gttttagagctagaaatagcaagttaaaataaggctagtccgtatagaacttgaaaaagtggcaccgagtcggtgcttttt

SEQ ID NO: 403 - DNA, 81 bp, Artificial Sequence
  source: /note="Description of Artificial Sequence: Synthetic oligonucleotide"
gttttagagctagaaatagcaagttaaaataaggctagtccgttatcacgccgaaaggcgggcaccgagtcggtgcttttt

SEQ ID NO: 404 - DNA, 89 bp, Artificial Sequence
  source: /note="Description of Artificial Sequence: Synthetic oligonucleotide"
gttttagagctagaaatagcaagttaaaataaggctagtccgttatcacgccggccgaaaggccggcgggcaccgagtcggtgcttttt

SEQ ID NO: 405 - DNA, 81 bp, Artificial Sequence
  source: /note="Description of Artificial Sequence: Synthetic oligonucleotide"
gttttagagctagaaatagcaagttaaaataaggctagtccgttatcaacttaaagaagtggcaccgagtcggtgcttttt

SEQ ID NO: 406 - DNA, 81 bp, Artificial Sequence
  source: /note="Description of Artificial Sequence: Synthetic oligonucleotide"
gttttagagctagaaatagcaagttaaaataaggctagtccgttatcaacttgaaaaagtggccccgcggcggggcttttt

SEQ ID NO: 407 - DNA, 83 bp, Artificial Sequence
  source: /note="Description of Artificial Sequence: Synthetic oligonucleotide"
gttttagagctagaaatagcaagttaaaataaggctagtccgttatcaacttgaaaaagtggcaccgaagttcggtgcttttt

SEQ ID NO: 408 - DNA, 85 bp, Artificial Sequence
  source: /note="Description of Artificial Sequence: Synthetic oligonucleotide"
gttttagagctagaaatagcaagttaaaataaggctagtccgttatcaacttgaaaaagtggcaccgaaagtttcggtgcttttt

SEQ ID NO: 409 - DNA, 81 bp, Artificial Sequence
  source: /note="Description of Artificial Sequence: Synthetic oligonucleotide"
gttttagagctagaaatagcaagctaaaataaggctagtccgttatcaacttgaaaaagtggcaccgagtcggtgcttttt

SEQ ID NO: 410 - DNA, 81 bp, Artificial Sequence
  source: /note="Description of Artificial Sequence: Synthetic oligonucleotide"
gttttagatctagaaatagcaaggtaaaataaggctagtccgttatcaacttgaaaaagtggcaccgagtcggtgcttttt

SEQ ID NO: 411 - DNA, 81 bp, Artificial Sequence
  source: /note="Description of Artificial Sequence: Synthetic oligonucleotide"
gttttagagctagaaatagcaagataaaataaggctagtccgttatcaacttgaaaaagtggcaccgagtcggtgcttttt

SEQ ID NO: 412 - DNA, 81 bp, Artificial Sequence
  source: /note="Description of Artificial Sequence: Synthetic oligonucleotide"
gttttagagctagaaatagcaagttaaaacaaggctagtccgttatcaacttgaaaaagtggcaccgagtcggtgcttttt

SEQ ID NO: 413 - DNA, 81 bp, Artificial Sequence
  source: /note="Description of Artificial Sequence: Synthetic oligonucleotide"
tttttagagctagaaatagcaagttaaaagaaggctagtccgttatcaacttgaaaaagtggcaccgagtcggtgcttttt

SEQ ID NO: 414 - DNA, 81 bp, Artificial Sequence
  source: /note="Description of Artificial Sequence: Synthetic oligonucleotide"
gttttagagctagaaatagcaagttaaaaaaaggctagtccgttatcaacttgaaaaagtggcaccgagtcggtgcttttt

SEQ ID NO: 415 - DNA, 81 bp, Artificial Sequence
  source: /note="Description of Artificial Sequence: Synthetic oligonucleotide"
gttttagagctagaaatagcaagttaaaataaggctagaccgttatcaacttgaaaaagtggcaccgagtcggtgcttttt

SEQ ID NO: 416 - DNA, 81 bp, Artificial Sequence
  source: /note="Description of Artificial Sequence: Synthetic oligonucleotide"
gttttagagctagaaatagcaagttaaaataaggctagcccgttatcaacttgaaaaagtggcaccgagtcggtgcttttt

SEQ ID NO: 417 - DNA, 81 bp, Artificial Sequence
  source: /note="Description of Artificial Sequence: Synthetic oligonucleotide"
gttttagagctagaaatagcaagttaaaataaggctagtccgttatcaacttgaaaaagtggcaccgaatcggtgcttttt

SEQ ID NO: 418 - DNA, 81 bp, Artificial Sequence
  source: /note="Description of Artificial Sequence: Synthetic oligonucleotide"
gttttagagctagaaatagcaagttaaaataaggctagtccgttatcaacttgaaaaagtggcaccgactcggtgcttttt

SEQ ID NO: 419 - DNA, 81 bp, Artificial Sequence
  source: /note="Description of Artificial Sequence: Synthetic oligonucleotide"
gttttagagctagaaatagcaagttaaaataaggctagtccgttatcaacttgaaaaagtggcaccgattcggtgcttttt

SEQ ID NO: 420 - DNA, 81 bp, Artificial Sequence
  source: /note="Description of Artificial Sequence: Synthetic oligonucleotide"
gttttagagctagaaatagcaagttaaaataaggctagtccgttatcaacttgaaaaagtggcaccgagacggtgcttttt

SEQ ID NO: 421 - DNA, 81 bp, Artificial Sequence
  source: /note="Description of Artificial Sequence: Synthetic oligonucleotide"
gttttagagctagaaatagcaagttaaaataaggctagtccgttatcaacttgaaaaagtggcaccgagccggtgcttttt

SEQ ID NO: 422 - DNA, 81 bp, Artificial Sequence
  source: /note="Description of Artificial Sequence: Synthetic oligonucleotide"
gttttagagctagaaatagcaagttaaaataaggctagtccgttatcaacttgaaaaagtggcaccgagtcggtgcttttt

SEQ ID NO: 423 - DNA, 111 bp, Artificial Sequence
  source: /note="Description of Artificial Sequence: Synthetic polynucleotide"
gttttagagctaggccaacatgaggatcacccatgtctgcagggcctagcaagttaaaataaggctagtccgttatcacgccgaaaggcgggcaccgagtcggtgcttttt

SEQ ID NO: 424 - DNA, 111 bp, Artificial Sequence
  source: /note="Description of Artificial Sequence: Synthetic polynucleotide"
gttttagagctagaaatagcaagttaaaataaggctagtccgttatcaacttggccaacatgaggatcacccatgtctgcagggccaagtggcaccgagtcggtgcttttt

SEQ ID NO: 425 - DNA, 141 bp, Artificial Sequence
  source: /note="Description of Artificial Sequence: Synthetic polynucleotide"
gttttagagctaggccaacatgaggatcacccatgtctgcagggcctagcaagttaaaataaggctagtccgttatcaacttggccaacatgaggatcacccatgtctgcagggccaagtggcaccgagtcggtgcttttt

SEQ ID NO: 426 - DNA, 25 bp, Homo sapiens
gagtccgagcagaagaagaagggct

SEQ ID NO: 427 - DNA, 50 bp, Artificial Sequence
  source: /note="Description of Artificial Sequence: Synthetic oligonucleotide"
ccatcacatcaaccggtggcgcattgccacgaagcaggccaatggggagg

SEQ ID NO: 428 - RNA, 98 nt, Artificial Sequence
  source: /note="Description of Artificial Sequence: Synthetic oligonucleotide"
ggaaauuaggugcgcuuggcguuuuagagcuagaaauagcaaguuaaaauaaggcuaguccguuaucaacuugaaaaaguggcaccgagucggugcuu

SEQ ID NO: 429 - RNA, 80 nt, Artificial Sequence
  source: /note="Description of Artificial Sequence: Synthetic oligonucleotide"
guuuuagagcuagaaauagcaaguuaaaauaaggcuaguccguuaucaacuugaaaaaguggcaccgagucggugcuuuu

SEQ ID NO: 430 - RNA, 46 nt, Artificial Sequence
  source: /note="Description of Artificial Sequence: Synthetic oligonucleotide"
guuuuagagcuagaaauagcaaguuaaaauaaggcuaguccguuuu

SEQ ID NO: 431 - RNA, 65 nt, Artificial Sequence
  source: /note="Description of Artificial Sequence: Synthetic oligonucleotide"
guuuuagagcuagaaauagcaaguuaaaauaaggcuaguccguuaucaacuugaaaaaguguuuu

SEQ ID NO: 432 - RNA, 80 nt, Artificial Sequence
  source: /note="Description of Artificial Sequence: Synthetic oligonucleotide"
gccccagagcuagaaauagcaaguugggguaaggcuaguccguuaucaacuugaaaaaguggcaccgagucggugcuuuu

SEQ ID NO: 433 - RNA, 71 nt, Artificial Sequence
  source: /note="Description of Artificial Sequence: Synthetic oligonucleotide"
guuuuagagacaaguuaaaauaaggcuaguccguuaucaacuugaaaaaguggcaccgagucggugcuuuu

SEQ ID NO: 434 - RNA, 78 nt, Artificial Sequence
  source: /note="Description of Artificial Sequence: Synthetic oligonucleotide"
guuuuagagcuagaaauagcuuuaaaauaaggcuaguccguuaucaacuugaaaaaguggcaccgagucggugcuuuu

SEQ ID NO: 435 - RNA, 80 nt, Artificial Sequence
  source: /note="Description of Artificial Sequence: Synthetic oligonucleotide"
guuuuagagcuagaaauagcaaguuaaaauaauucuaguaaguuaucaacuugaaaaaguggcaccgagucggugcuuuu

SEQ ID NO: 436 - RNA, 80 nt, Artificial Sequence
  source: /note="Description of Artificial Sequence: Synthetic oligonucleotide"
guuuuagagcuagaaauagcaaguuaaaauaagccaugugcguuaucaacuugaaaaaguggcaccgagucggugcuuuu

SEQ ID NO: 437 - RNA, 76 nt, Artificial Sequence
  source: /note="Description of Artificial Sequence: Synthetic oligonucleotide"
guuuuagagcuagaaauagcaaguuaaaauaaggcuaguccguaacuugaaaaaguggcaccgagucggugcuuuu

SEQ ID NO: 438 - RNA, 80 nt, Artificial Sequence
  source: /note="Description of Artificial Sequence: Synthetic oligonucleotide"
guuuuagagcuagaaauagcaaguuaaaauaaggcuaguccguuaucacgccgaaaggcgggcaccgagucggugcuuuu

SEQ ID NO: 439 - RNA, 84 nt, Artificial Sequence
  source: /note="Description of Artificial Sequence: Synthetic oligonucleotide"
guuuuagagcuagaaauagcaaguuaaaauaaggcuaguccguuaucaacuugagaaaucaaguggcaccgagucggugcuuuu

SEQ ID NO: 440 - RNA, 80 nt, Artificial Sequence
  source: /note="Description of Artificial Sequence: Synthetic oligonucleotide"
guuuuagagcuagaaauagcaaguuaaaauaaggcuaguccguuaucaacuugaaaaaguggccccgcggcggggcuuuu

SEQ ID NO: 441 - RNA, 84 nt, Artificial Sequence
  source: /note="Description of Artificial Sequence: Synthetic oligonucleotide"
guuuuagagcuagaaauagcaaguuaaaauaaggcuaguccguuaucaacuugaaaaaguggcaccgaaaguuucggugcuuuu

SEQ ID NO: 442 - RNA, 76 nt, Artificial Sequence
  source: /note="Description of Artificial Sequence: Synthetic oligonucleotide"
gccccagagcauuagcaaguugggguaagccaugugcguuaucagggcaccagcccggcaccgagucggugcuuuu

SEQ ID NO: 443 - RNA, 97 nt, Artificial Sequence
  source: /note="Description of Artificial Sequence: Synthetic oligonucleotide"
ggaaauuaggugcgcuuggcguuuuagagcuagaaauagcaaguuaaaauaaggcuaguccguuaucaacuugaaaaaguggcaccgagucggugcu

SEQ ID NO: 444 - DNA, 57 bp, Homo sapiens
aagctggaggaggaagggcctgagtccgagcagaagaagaagggctcccatcacatc

SEQ ID NO: 445 - protein, 1368 aa, Streptococcus pyogenes [sequence omitted]

SEQ ID NO: 446 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 447 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 448 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 449 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 450 - protein, 1236 aa, Neisseria meningiditis
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 451 - RNA, 13 nt, Artificial Sequence
  source: /note="Description of Artificial Sequence: Synthetic oligonucleotide"
gcuagaaauagca

SEQ ID NO: 452 - RNA, 9 nt, Artificial Sequence
  source: /note="Description of Artificial Sequence: Synthetic oligonucleotide"
ggcuagucc

SEQ ID NO: 453 - RNA, 13 nt, Artificial Sequence
  source: /note="Description of Artificial Sequence: Synthetic oligonucleotide"
caccgagucggug

SEQ ID NO: 454 - DNA, 158 bp, Artificial Sequence
  source: /note="Description of Artificial Sequence: Synthetic oligonucleotide"
  source: /note="Description of Combined DNA/RNA Molecule: Synthetic oligonucleotide"
  modified_base (1)..(20): a, c, t, g, unknown or other
nnnnnnnnnnnnnnnnnnnnguuuuagagcuaggccaacatgaggatcacccatgtctgcagggccuagcaaguuaaaauaaggcuaguccguuaucaacuuggccaacatgaggatcacccatgtctgcagggccaaguggcaccgagucggugcuu

SEQ ID NO: 455 - DNA, 138 bp, Artificial Sequence
  source: /note="Description of Artificial Sequence: Synthetic oligonucleotide"
  source: /note="Description of Combined DNA/RNA Molecule: Synthetic oligonucleotide"
guuuuagagcuaggccaacatgaggatcacccatgtctgcaggccuagcaaguuaaaauaaggcuaguccguuaucaacuuggccaacatgaggatcacccatgtctgcaggccaaguggcaccgagucggugcuuuu

SEQ ID NO: 456 - RNA, 72 nt, Artificial Sequence
  source: /note="Description of Artificial Sequence: Synthetic oligonucleotide"
guuuuagagcuauagcaaguuaaaauaaggcuaguccguuaucaacuuaaguggcaccgagucggugcuuuu

SEQ ID NO: 457 - RNA, 82 nt, Artificial Sequence
  source: /note="Description of Artificial Sequence: Synthetic oligonucleotide"
guuuaagagcuaugcugcagcauagcaaguuuaaauaaggcuaguccguuaucaacuuaaguggcaccgagucggugcuuuu

SEQ ID NO: 458 - DNA, 105 bp, Artificial Sequence
  source: /note="Description of Artificial Sequence: Synthetic oligonucleotide"
  source: /note="Description of Combined DNA/RNA Molecule: Synthetic oligonucleotide"
guuuuagagcuaggccaacatgaggatcacccatgtctgcaggccuagcaaguuaaaauaaggcuaguccguuaucaacuuaaguggcaccgagucggugcuuuu

SEQ ID NO: 459 - DNA, 138 bp, Artificial Sequence
  source: /note="Description of Artificial Sequence: Synthetic oligonucleotide"
  source: /note="Description of Combined DNA/RNA Molecule: Synthetic oligonucleotide"
guuuaagagcuaggccaacatgaggatcacccatgtctgcaggccuagcaaguuuaaauaaggcuaguccguuaucaacuuggccaacatgaggatcacccatgtctgcaggccaaguggcaccgagucggugcuuuu

SEQ ID NO: 460 - DNA, 148 bp, Artificial Sequence
  source: /note="Description of Artificial Sequence: Synthetic oligonucleotide"
  source: /note="Description of Combined DNA/RNA Molecule: Synthetic oligonucleotide"
guuuaagagcuaugcugggccaacatgaggatcacccatgtctgcaggcccagcauagcaaguuuaaauaaggcuaguccguuaucaacuuggccaacatgaggatcacccatgtctgcaggccaaguggcaccgagucggugcuuuu

SEQ ID NO: 461 - DNA, 130 bp, Artificial Sequence
  source: /note="Description of Artificial Sequence: Synthetic oligonucleotide"
  source: /note="Description of Combined DNA/RNA Molecule: Synthetic oligonucleotide"
guuuuagagcuaaacatgaggatcacccatgtctgcauagcaaguuaaaauaaggcuaguccguuaucaacuuggccaacatgaggatcacccatgtctgcaggccaaguggcaccgagucggugcuuuu

SEQ ID NO: 462 - DNA, 124 bp, Artificial Sequence
  source: /note="Description of Artificial Sequence: Synthetic oligonucleotide"
  source: /note="Description of Combined DNA/RNA Molecule: Synthetic oligonucleotide"
guuuuagagaacatgaggatcacccatgtctgcacaaguuaaaauaaggcuaguccguuaucaacuuggccaacatgaggatcacccatgtctgcaggccaaguggcaccgagucggugcuuuu

SEQ ID NO: 463 - DNA, 130 bp, Artificial Sequence
  source: /note="Description of Artificial Sequence: Synthetic oligonucleotide"
  source: /note="Description of Combined DNA/RNA Molecule: Synthetic oligonucleotide"
guuuuagagcuaggccaacatgaggatcacccatgtctgcaggccuagcaaguuaaaauaaggcuaguccguuaucaacuuaacatgaggatcacccatgtctgcaaaguggcaccgagucggugcuuuu

SEQ ID NO: 464 - DNA, 122 bp, Artificial Sequence
  source: /note="Description of Artificial Sequence: Synthetic oligonucleotide"
  source: /note="Description of Combined DNA/RNA Molecule: Synthetic oligonucleotide"
guuuuagagcuaggccaacatgaggatcacccatgtctgcaggccuagcaaguuaaaauaaggcuaguccguuaucaaacatgaggatcacccatgtctgcaggcaccgagucggugcuuuu

SEQ ID NO: 465 - DNA, 390 bp, Artificial Sequence
  source: /note="Description of Artificial Sequence: Synthetic polynucleotide"
atggcttcaaactttactcagttcgtgctcgtggacaatggtgggacaggggatgtgacagtggctccttctaatttcgctaatggggtggcagagtggatcagctccaactcacggagccaggcctacaaggtgacatgcagcgtcaggcagtctagtgcccagaagagaaagtataccatcaaggtggaggtccccaaagtggctacccagacagtgggcggagtcgaactgcctgtcgccgcttggaggtcctacctgaacatggagctcactatcccaattttcgctaccaattctgactgtgaactcatcgtgaaggcaatgcaggggctcctcaaagacggtaatcctatcccttccgccatcgccgctaactcaggtatctac

SEQ ID NO: 466 - DNA, 33 bp, Artificial Sequence
  source: /note="Description of Artificial Sequence: Synthetic oligonucleotide"
ggacctaagaaaaagaggaaggtggcggccgct

SEQ ID NO: 467 - DNA, 165 bp, Artificial Sequence
  source: /note="Description of Artificial Sequence: Synthetic polynucleotide"
ggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaac

SEQ ID NO: 468 - DNA, 552 bp, Artificial Sequence
  source: /note="Description of Artificial Sequence: Synthetic polynucleotide"
ccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcag

SEQ ID NO: 469 - DNA, 1419 bp, Artificial Sequence
  source: /note="Description of Artificial Sequence: Synthetic polynucleotide"
atggcttcaaactttactcagttcgtgctcgtggacaatggtgggacaggggatgtgacagtggctccttctaatttcgctaatggggtggcagagtggatcagctccaactcacggagccaggcctacaaggtgacatgcagcgtcaggcagtctagtgcccagaagagaaagtataccatcaaggtggaggtccccaaagtggctacccagacagtgggcggagtcgaactgcctgtcgccgcttggaggtcctacctgaacatggagctcactatcccaattttcgctaccaattctgactgtgaactcatcgtgaaggcaatgcaggggctcctcaaagacggtaatcctatcccttccgccatcgccgctaactcaggtatctacagcgctggaggaggtggaagcggaggaggaggaagcggaggaggaggtagcggacctaagaaaaagaggaaggtggcggccgctggatccccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcagggaggaggtggaagcggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcc

SEQ ID NO: 470 - DNA, 372 bp, Artificial Sequence
  source: /note="Description of Artificial Sequence: Synthetic polynucleotide"
ggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcc

SEQ ID NO: 471 - DNA, 1236 bp, Artificial Sequence
  source: /note="Description of Artificial Sequence: Synthetic polynucleotide"
atggcttcaaactttactcagttcgtgctcgtggacaatggtgggacaggggatgtgacagtggctccttctaatttcgctaatggggtggcagagtggatcagctccaactcacggagccaggcctacaaggtgacatgcagcgtcaggcagtctagtgcccagaagagaaagtataccatcaaggtggaggtccccaaagtggctacccagacagtgggcggagtcgaactgcctgtcgccgcttggaggtcctacctgaacatggagctcactatcccaattttcgctaccaattctgactgtgaactcatcgtgaaggcaatgcaggggctcctcaaagacggtaatcctatcccttccgccatcgccgctaactcaggtatctacagcgctggaggaggtggaagcggaggaggaggaagcggaggaggaggtagcggacctaagaaaaagaggaaggtggcggccgctggatccccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcagggaggaggtggaagcatggagcttctttctcctcctctgcgggatgttgacctgactgcgcccgacggctctctttgctccttcgccacaaccgacgacttctacgatgatccatgttttgacagccccgatctcaggttctttgaggatctcgatcctagactgatgcacgtgggcgcactgctcaaacctgaggaacatagc

SEQ ID NO: 472 - DNA, 189 bp, Artificial Sequence
  source: /note="Description of Artificial Sequence: Synthetic polynucleotide"
atggagcttctttctcctcctctgcgggatgttgacctgactgcgcccgacggctctctttgctccttcgccacaaccgacgacttctacgatgatccatgttttgacagccccgatctcaggttctttgaggatctcgatcctagactgatgcacgtgggcgcactgctcaaacctgaggaacatagc

SEQ ID NO: 473 - DNA, 4356 bp, Artificial Sequence
  source: /note="Description of Artificial Sequence: Synthetic polynucleotide"
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgctggatccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaac

SEQ ID NO: 474 - DNA, 4101 bp, Artificial Sequence
  source: /note="Description of Artificial Sequence: Synthetic polynucleotide"
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgac

SEQ ID NO: 475 - DNA, 4743 bp, Artificial Sequence
  source: /note="Description of Artificial Sequence: Synthetic polynucleotide"
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgctggatccccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcag

SEQ ID NO: 476 - DNA, 6131 bp, Artificial Sequence
  source: /note="Description of Artificial Sequence: Synthetic polynucleotide"
tgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgacgtacggccacccatgagccccaagaagaagagaaaggtggaggccagcgacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccacatcgtgcctcagagctttctgaaggacgactccatcgacaacaaggtgctgaccagaagcgacaaggcccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacagcgctggaggaggtggaagcggaggaggaggaagcggaggaggaggtagcggacctaagaaaaagaggaaggtggcggccgctggatccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactgtacaggcagtggagagggcagaggaagtctgctaacatgcggtgacgtcgaggagaatcctggcccaatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaa

SEQ ID NO: 477 - DNA, 1258 bp, Artificial Sequence
  source: /note="Description of Artificial Sequence: Synthetic polynucleotide"
tgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 478 - DNA, 36 bp, Artificial Sequence
  source: /note="Description of Artificial Sequence: Synthetic oligonucleotide"
atgagccccaagaagaagagaaaggtggaggccagc

SEQ ID NO: 479 - DNA, 4101 bp, Artificial Sequence
  source: /note="Description of Artificial Sequence: Synthetic polynucleotide"
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccacatcgtgcctcagagctttctgaaggacgactccatcgacaacaaggtgctgaccagaagcgacaaggcccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgac

SEQ ID NO: 480 - DNA, 63 bp, Artificial Sequence
  source: /note="Description of Artificial Sequence: Synthetic oligonucleotide"
ggcagtggagagggcagaggaagtctgctaacatgcggtgacgtcgaggagaatcctggccca

SEQ ID NO: 481 - DNA, 399 bp, Artificial Sequence
  source: /note="Description of Artificial Sequence: Synthetic polynucleotide"
atggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaa

SEQ ID NO: 482 - DNA, 3797 bp, Artificial Sequence
  source: /note="Description of Artificial Sequence: Synthetic polynucleotide"
tgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgacgtacggccaccatggcttcaaactttactcagttcgtgctcgtggacaatggtgggacaggggatgtgacagtggctccttctaatttcgctaatggggtggcagagtggatcagctccaactcacggagccaggcctacaaggtgacatgcagcgtcaggcagtctagtgcccagaagagaaagtataccatcaaggtggaggtccccaaagtggctacccagacagtgggcggagtcgaactgcctgtcgccgcttggaggtcctacctgaacatggagctcactatcccaattttcgctaccaattctgactgtgaactcatcgtgaaggcaatgcaggggctcctcaaagacggtaatcctatcccttccgccatcgccgctaactcaggtatctacagcgctggaggaggtggaagcggaggaggaggaagcggaggaggaggtagcggacctaagaaaaagaggaaggtggcggccgctggatccccttcagggcagatcagcaaccaggccctggctctggcccctagctccgctccagtgctggcccagactatggtgccctctagtgctatggtgcctctggcccagccacctgctccagcccctgtgctgaccccaggaccaccccagtcactgagcgctccagtgcccaagtctacacaggccggcgaggggactctgagtgaagctctgctgcacctgcagttcgacgctgatgaggacctgggagctctgctggggaacagcaccgatcccggagtgttcacagatctggcctccgtggacaactctgagtttcagcagctgctgaatcagggcgtgtccatgtctcatagtacagccgaaccaatgctgatggagtaccccgaagccattacccggctggtgaccggcagccagcggccccccgaccccgctccaactcccctgggaaccagcggcctgcctaatgggctgtccggagatgaagacttctcaagcatcgctgatatggactttagtgccctgctgtcacagatttcctctagtgggcagggaggaggtggaagcggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctgtacaggcagtggagagggcagaggaagtctgctaacatgcggtgacgtcgaggagaatcctggcccaaccatgaaaaagcctgaactcaccgctacctctgtcgagaagtttctgatcgaaaagttcgacagcgtctccgacctgatgcagctctccgagggcgaagaatctcgggctttcagcttcgatgtgggagggcgtggatatgtcctgcgggtgaatagctgcgccgatggtttctacaaagatcgctatgtttatcggcactttgcatccgccgctctccctattcccgaagtgcttgacattggggagttcagcgagagcctgacctattgcatctcccgccgtgcacagggtgtcaccttgcaagacctgcctgaaaccgaactgcccgctgttctccagcccgtcgccgaggccatggatgccatcgctgccgccgatcttagccagaccagcgggttcggcccattcggacctcaaggaatcggtcaatacactacatggcgcgatttcatctgcgctattgctgatccccatgtgtatcactggcaaactgtgatggacgacaccgtcagtgcctccgtcgcccaggctctcgatgagctgatgctttgggccgaggactgccccgaagtccggcacctcgtgcacgccgatttcggctccaacaatgtcctgaccgacaatggccgcataacagccgtcattgactggagcgaggccatgttcggggattcccaatacgaggtcgccaacatcttcttctggaggccctggttggcttgtatggagcagcagacccgctacttcgagcggaggcatcccgagcttgcaggatctcctcggctccgggcttatatgctccgcattggtcttgaccaactctatcagagcttggttgacggcaatttcgatgatgcagcttgggctcagggtcgctgcgacgcaatcgtccggtccggagccgggactgtcgggcgtacacaaatcgcccgcagaagcgctgccgtctggaccgatggctgtgtggaagtgctcgccgatagtggaaacagacgccccagcactcgtcctagggcaaaggatctgcagtaatga

SEQ ID NO: 483 - DNA, 1259 bp, Artificial Sequence
  source: /note="Description of Artificial Sequence: Synthetic polynucleotide"
tgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 484 - DNA, 1038 bp, Artificial Sequence
  source: /note="Description of Artificial Sequence: Synthetic polynucleotide"
accatgaaaaagcctgaactcaccgctacctctgtcgagaagtttctgatcgaaaagttcgacagcgtctccgacctgatgcagctctccgagggcgaagaatctcgggctttcagcttcgatgtgggagggcgtggatatgtcctgcgggtgaatagctgcgccgatggtttctacaaagatcgctatgtttatcggcactttgcatccgccgctctccctattcccgaagtgcttgacattggggagttcagcgagagcctgacctattgcatctcccgccgtgcacagggtgtcaccttgcaagacctgcctgaaaccgaactgcccgctgttctccagcccgtcgccgaggccatggatgccatcgctgccgccgatcttagccagaccagcgggttcggcccattcggacctcaaggaatcggtcaatacactacatggcgcgatttcatctgcgctattgctgatccccatgtgtatcactggcaaactgtgatggacgacaccgtcagtgcctccgtcgcccaggctctcgatgagctgatgctttgggccgaggactgccccgaagtccggcacctcgtgcacgccgatttcggctccaacaatgtcctgaccgacaatggccgcataacagccgtcattgactggagcgaggccatgttcggggattcccaatacgaggtcgccaacatcttcttctggaggccctggttggcttgtatggagcagcagacccgctacttcgagcggaggcatcccgagcttgcaggatctcctcggctccgggcttatatgctccgcattggtcttgaccaactctatcagagcttggttgacggcaatttcgatgatgcagcttgggctcagggtcgctgcgacgcaatcgtccggtccggagccgggactgtcgggcgtacacaaatcgcccgcagaagcgctgccgtctggaccgatggctgtgtggaagtgctcgccgatagtggaaacagacgccccagcactcgtcctagggcaaaggatctgcagtaatga

SEQ ID NO: 485 - DNA, 2057 bp, Artificial Sequence
  source: /note="Description of Artificial Sequence: Synthetic polynucleotide"
gagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggagacgggataccgtctctgttttagagctaggccaacatgaggatcacccatgtctgcagggcctagcaagttaaaataaggctagtccgttatcaacttggccaacatgaggatcacccatgtctgcagggccaagtggcaccgagtcggtgctttttttggatcctgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgatgtacaatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactga

SEQ ID NO: 486 - DNA, 249 bp, Artificial Sequence
  source: /note="Description of Artificial Sequence: Synthetic polynucleotide"
gagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacc

SEQ ID NO: 487 - DNA, 136 bp, Artificial Sequence
  source: /note="Description of Artificial Sequence: Synthetic polynucleotide"
gttttagagctaggccaacatgaggatcacccatgtctgcagggcctagcaagttaaaataaggctagtccgttatcaacttggccaacatgaggatcacccatgtctgcagggccaagtggcaccgagtcggtgc

SEQ ID NO: 488 - DNA, 1258 bp, Artificial Sequence
  source: /note="Description of Artificial Sequence: Synthetic polynucleotide"
tgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 489 - DNA, 375 bp, Artificial Sequence
  source: /note="Description of Artificial Sequence: Synthetic polynucleotide"
atggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactga

SEQ ID NO: 490 - DNA, 2282 bp, Artificial Sequence
  source: /note="Description of Artificial Sequence: Synthetic polynucleotide"
gagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggagacgggataccgtctctgttttagagctaggccaacatgaggatcacccatgtctgcagggcctagcaagttaaaataaggctagtccgttatcaacttggccaacatgaggatcacccatgtctgcagggccaagtggcaccgagtcggtgctttttttggatcctgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccaccggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgatgtacaatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgccgtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 491 - DNA, 1258 bp, Artificial Sequence
  source: /note="Description of Artificial Sequence: Synthetic polynucleotide"
tgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccaccggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 492 - DNA, 600 bp, Artificial Sequence
  source: /note="Description of Artificial Sequence: Synthetic polynucleotide"
atgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgccgtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 493 - DNA, 20 bp, Homo sapiens
tggttcagtggctgcgtgtc

SEQ ID NO: 494 - DNA, 20 bp, Homo sapiens
gccggccgcgcgggggaggc

SEQ ID NO: 495 - DNA, 20 bp, Homo sapiens
ccatgtgacgggggctgtca

SEQ ID NO: 496 - DNA, 20 bp, Homo sapiens
ggcaggcgaggagggggagg

SEQ ID NO: 497 - DNA, 20 bp, Homo sapiens
gctgccgggttttgcatgaa

SEQ ID NO: 498 - DNA, 20 bp, Homo sapiens
gtatcccctctcgcagcaac

SEQ ID NO: 499 - DNA, 20 bp, Homo sapiens
aggagccgccgcgcgctgat

SEQ ID NO: 500 - DNA, 20 bp, Homo sapiens
tttacccacttccttcgaaa

SEQ ID NO: 501 - DNA, 20 bp, Homo sapiens
gcagggtacttaaatgagga

SEQ ID NO: 502 - DNA, 20 bp, Homo sapiens
cgccaggaggggtgggtcta

SEQ ID NO: 503 - DNA, 20 bp, Homo sapiens
gattaactgagaattcacaa

SEQ ID NO: 504 - DNA, 20 bp, Homo sapiens
tctagttccccacctagtct

SEQ ID NO: 505 - DNA, 20 bp, Homo sapiens
gccttggtgagactggtaga

SEQ ID NO: 506 - DNA, 20 bp, Homo sapiens
tgtcttcaggttctgttgct

SEQ ID NO: 507 - DNA, 20 bp, Homo sapiens
tgatttaaaagttggaaacg

SEQ ID NO: 508 - DNA, 20 bp, Homo sapiens
catattcctgatttaaaagt

SEQ ID NO: 509 - DNA, 20 bp, Homo sapiens
tcccaatttactgggattac

SEQ ID NO: 510 - DNA, 20 bp, Homo sapiens
gcgcgctccacacaactcac

SEQ ID NO: 511 - DNA, 20 bp, Homo sapiens
aaggaacgcgcgccggcggc

SEQ ID NO: 512 - DNA, 20 bp, Homo sapiens
atgggagaaggcggaggaaa

SEQ ID NO: 513 - DNA, 20 bp, Homo sapiens
gcaacgatggaagggagcct

SEQ ID NO: 514 - DNA, 20 bp, Homo sapiens
gcgcacgtgggggcggggga

SEQ ID NO: 515 - DNA, 20 bp, Homo sapiens
gcctggctggcgtcacggcc

SEQ ID NO: 516 - DNA, 20 bp, Homo sapiens
gccgccgacaccactgccgc

SEQ ID NO: 517 - DNA, 20 bp, Homo sapiens
cggttcctcgcgccccgcgc

SEQ ID NO: 518 - DNA, 20 bp, Homo sapiens
gacacaactggcgcccctcc

SEQ ID NO: 519 - DNA, 20 bp, Homo sapiens
ggggggagaaactgaggcga

SEQ ID NO: 520 - DNA, 20 bp, Homo sapiens
tctgtgggggacctgcactg

SEQ ID NO: 521 - DNA, 20 bp, Homo sapiens
ggcacagtgccagaggtctg

SEQ ID NO: 522 - DNA, 20 bp, Homo sapiens
ggtgaaatgagggcttgcga

SEQ ID NO: 523 - DNA, 20 bp, Homo sapiens
tcaaggctagtgggtgggac

SEQ ID NO: 524 - DNA, 20 bp, Homo sapiens
ggtggtggcaatggtgtctg

SEQ ID NO: 525 - DNA, 20 bp, Homo sapiens
acaggaattcaagaccagcc

SEQ ID NO: 526 - DNA, 20 bp, Homo sapiens
gcaaagagggaacggctctc

SEQ ID NO: 527 - DNA, 20 bp, Homo sapiens
acagagtttccgggggcgga

SEQ ID NO: 528 - DNA, 20 bp, Homo sapiens
cccttcattgcggcgggctg

SEQ ID NO: 529 - DNA, 20 bp, Homo sapiens
ggcccgagccgcgtgtggaa

SEQ ID NO: 530 - DNA, 20 bp, Homo sapiens
gcgggccgggggcggggtcc

SEQ ID NO: 531 - DNA, 20 bp, Homo sapiens
tttaaaagtcggctggtagc

SEQ ID NO: 532 - DNA, 20 bp, Homo sapiens
tccctgaacttttcaaaaat

SEQ ID NO: 533 - DNA, 20 bp, Homo sapiens
cactggagctagagacaaga

SEQ ID NO: 534 - DNA, 20 bp, Homo sapiens
gtatcctctatgatgggaga

SEQ ID NO: 535 - DNA, 20 bp, Homo sapiens
aaaaactggaatgactgaat

SEQ ID NO: 536 - DNA, 20 bp, Homo sapiens
aaaattagcagtatcctctt

SEQ ID NO: 537 - DNA, 20 bp, Homo sapiens
atgcaaatatctgtctgaaa

SEQ ID NO: 538 - DNA, 20 bp, Homo sapiens
cttgaccaatagccttgaca

SEQ ID NO: 539 - DNA, 20 bp, Homo sapiens
ggctagggatgaagaataaa

SEQ ID NO: 540 - DNA, 20 bp, Homo sapiens
gccgcacgcacctgttccca

SEQ ID NO: 541 - DNA, 20 bp, Homo sapiens
ctgcaccctgggagcgcgag

SEQ ID NO: 542 - DNA, 20 bp, Homo sapiens
gcccggagcagctgcgctgt

SEQ ID NO: 543 - DNA, 20 bp, Homo sapiens
ccaggaccgcgcttcccacg

SEQ ID NO: 544 - DNA, 20 bp, Homo sapiens
gagctggaaggtgaaggggc

SEQ ID NO: 545 - DNA, 20 bp, Homo sapiens
cccgacccctcccgggtccc

SEQ ID NO: 546 - DNA, 20 bp, Homo sapiens
ggaaaggaaggggaggggct

SEQ ID NO: 547 - DNA, 20 bp, Homo sapiens
gcggccccgccctctcctcg

SEQ ID NO: 548 - DNA, 20 bp, Homo sapiens
ttagtatatgtgggacaaag

SEQ ID NO: 549 - DNA, 20 bp, Homo sapiens
gaaaatccagtattttaatg

SEQ ID NO: 550 - DNA, 20 bp, Homo sapiens
gaaaacaatgcatatttgca

SEQ ID NO: 551 - DNA, 20 bp, Homo sapiens
ctctggttcatggaagggca

SEQ ID NO: 552 - DNA, 20 bp, Homo sapiens
agtattggtggaagcttctt

SEQ ID NO: 553 - DNA, 20 bp, Homo sapiens
tttaacttgattgtgaaatc

SEQ ID NO: 554 - DNA, 20 bp, Homo sapiens
tggctttcaaaagcagaagt

SEQ ID NO: 555 - DNA, 20 bp, Homo sapiens
aaaaacagcgagggagaaac

SEQ ID NO: 556 - DNA, 20 bp, Homo sapiens
aaactccacaatctagaata

SEQ ID NO: 557 - DNA, 20 bp, Homo sapiens
ttaacagttaaaaatcatac

SEQ ID NO: 558 - DNA, 20 bp, Homo sapiens
tggaaaaccaactcttccac

SEQ ID NO: 559 - DNA, 20 bp, Homo sapiens
agcatctttttctctttaat

SEQ ID NO: 560 - DNA, 20 bp, Homo sapiens
atcactttaaaaccacctct

SEQ ID NO: 561 - DNA, 20 bp, Homo sapiens
aaacttatgcggcgtttcct

SEQ ID NO: 562 - DNA, 20 bp, Homo sapiens
gagtacatgatcacccagat

SEQ ID NO: 563 - DNA, 20 bp, Homo sapiens
gacccagcactgcagcctgg

SEQ ID NO: 564 - DNA, 20 bp, Homo sapiens
tagcaatacagtcacattaa

SEQ ID NO: 565 - DNA, 20 bp, Homo sapiens
gccgggcgtctgggctctgg

SEQ ID NO: 566 - DNA, 20 bp, Homo sapiens
tgcccggcggccgggctgag

SEQ ID NO: 567 - DNA, 20 bp, Homo sapiens
gcctgggggccccgggctga

SEQ ID NO: 568 - DNA, 20 bp, Homo sapiens
ccgggcagagagtgaacgcg

SEQ ID NO: 569 - DNA, 20 bp, Homo sapiens
gcggcgccccagggcggggc

SEQ ID NO: 570 - DNA, 20 bp, Homo sapiens
accctggcggagctgatggg

SEQ ID NO: 571 - DNA, 20 bp, Homo sapiens
gggtcttgggagggggcgca

SEQ ID NO: 572 - DNA, 20 bp, Homo sapiens
ggccccacggaagcctgagc

SEQ ID NO: 573 - DNA, 20 bp, Homo sapiens
cagtgcgttctcggtgtgga

SEQ ID NO: 574 - DNA, 20 bp, Homo sapiens
tttgtcaaacagtactgcta

SEQ ID NO: 575 - DNA, 20 bp, Homo sapiens
gcgcgcgtagttaattcatg

SEQ ID NO: 576 - DNA, 20 bp, Homo sapiens
agctagagtgctcggctgcc

SEQ ID NO: 577 - DNA, 20 bp, Homo sapiens
ggttcccaaagcagagggcg

SEQ ID NO: 578 - DNA, 20 bp, Homo sapiens
tctcgctaatctccgcccac

SEQ ID NO: 579 - DNA, 20 bp, Homo sapiens
ccctttataatgcgagggtc

SEQ ID NO: 580 - DNA, 20 bp, Homo sapiens
agaagcaggccgcgcattcc

SEQ ID NO: 581 - DNA, 20 bp, Homo sapiens
gcgggtcagctccaagcagc

SEQ ID NO: 582 - DNA, 20 bp, Homo sapiens
tctgattggccagcgccgcc

SEQ ID NO: 583 - DNA, 20 bp, Homo sapiens
cccatctccagttgtgcgtg

SEQ ID NO: 584 - DNA, 20 bp, Homo sapiens
tctgagaagggacaccccag

SEQ ID NO: 585 - DNA, 20 bp, Homo sapiens
cggagggaaagggaggggaa

SEQ ID NO: 586 - DNA, 20 bp, Homo sapiens
ggggctgcccgcggggggtt

SEQ ID NO: 587 - DNA, 20 bp, Homo sapiens
gggagcctttgaaaagccgt

SEQ ID NO: 588 - DNA, 20 bp, Homo sapiens
tgggcaggcccggcccggcg

SEQ ID NO: 589 - DNA, 20 bp, Homo sapiens
gcgcactctggggccagcag

SEQ ID NO: 590 - DNA, 20 bp, Homo sapiens
ggctgggatgacctcgctga

SEQ ID NO: 591 - DNA, 20 bp, Homo sapiens
tgatctttttaaggacaggc

SEQ ID NO: 592 - DNA, 20 bp, Homo sapiens
tctcaagtagctgggactac

SEQ ID NO: 593 - DNA, 20 bp, Homo sapiens
caggtgcggtggctcatgcc

SEQ ID NO: 594 - DNA, 20 bp, Homo sapiens
ctcactgcaacctctgtctg

SEQ ID NO: 595 - DNA, 20 bp, Homo sapiens
ggtggggcagggaaggaagg

SEQ ID NO: 596 - DNA, 20 bp, Homo sapiens
gcaccattcacccgggggag

SEQ ID NO: 597 - DNA, 20 bp, Homo sapiens
tgcacccgtcgtccccgccg

SEQ ID NO: 598 - DNA, 20 bp, Homo sapiens
gtgggcggagcgggggggcc

SEQ ID NO: 599 - DNA, 20 bp, Homo sapiens
gcgcgctcttcacttcttgg

SEQ ID NO: 600 - DNA, 20 bp, Homo sapiens
tcgtagagaaacatgacggt

SEQ ID NO: 601 - DNA, 20 bp, Homo sapiens
cgcggctgcggcggcggccg

SEQ ID NO: 602 - DNA, 20 bp, Homo sapiens
ttggcggcctctgcgcccgc

SEQ ID NO: 603 - DNA, 20 bp, Homo sapiens
tcggagccactccctcctct

SEQ ID NO: 604 - DNA, 20 bp, Homo sapiens
aatttgtcatagtcttgagt

SEQ ID NO: 605 - DNA, 20 bp, Homo sapiens
tctttttacattgactgata

SEQ ID NO: 606 - DNA, 20 bp, Homo sapiens
tgcttttgaatgaacaccca

SEQ ID NO: 607 - DNA, 20 bp, Homo sapiens
ttggggtctactcacaattt

SEQ ID NO: 608 - DNA, 20 bp, Homo sapiens
gttctgtgaagtccagtccc

SEQ ID NO: 609 - DNA, 20 bp, Homo sapiens
agcaagtactcaatatattt

SEQ ID NO: 610 - DNA, 20 bp, Homo sapiens
agtagagaggccaggcacag

SEQ ID NO: 611 - DNA, 20 bp, Homo sapiens
taaaatagagcggagatatc

SEQ ID NO: 612 - DNA, 20 bp, Homo sapiens
ccttcttgaaggtgcactca

SEQ ID NO: 613 - DNA, 20 bp, Homo sapiens
caggctgtggttgtgacctg

SEQ ID NO: 614 - DNA, 20 bp, Homo sapiens
tttctctcctgcgtcctggg

SEQ ID NO: 615 - DNA, 20 bp, Homo sapiens
cacgcttccagccacccgct

SEQ ID NO: 616 - DNA, 20 bp, Homo sapiens
cgatgcgcttgctgggtcgc

SEQ ID NO: 617 - DNA, 20 bp, Homo sapiens
ggctcccagccccagccccc

SEQ ID NO: 618 - DNA, 20 bp, Homo sapiens
accagctgccttcttccccc

SEQ ID NO: 619 - DNA, 20 bp, Homo sapiens
cagcccctccttctaccctt

SEQ ID NO: 620 - DNA, 20 bp, Homo sapiens
gggcaggaggtggagtgtca

SEQ ID NO: 621 - DNA, 20 bp, Homo sapiens
gggggccggagggggagagg

SEQ ID NO: 622 - DNA, 20 bp, Homo sapiens
gcaggctgagaagggtgggc

SEQ ID NO: 623 - DNA, 20 bp, Homo sapiens
tctcatcaagtgtccactca

SEQ ID NO: 624 - DNA, 20 bp, Homo sapiens
gtctcccatctctcctgccc

SEQ ID NO: 625 - DNA, 20 bp, Homo sapiens
gggtgtggaaagcctggtct

SEQ ID NO: 626 - DNA, 20 bp, Homo sapiens
tgactctaggcagagtggga

SEQ ID NO: 627 - DNA, 20 bp, Homo sapiens
tcgcggctggaggacgctgc

SEQ ID NO: 628 - DNA, 20 bp, Homo sapiens
cgccccagccccgggggacg

SEQ ID NO: 629 - DNA, 20 bp, Homo sapiens
cagggacacgatggtccaaa

SEQ ID NO: 630 - DNA, 20 bp, Homo sapiens
gtcaggagtttccagcccga

SEQ ID NO: 631 - DNA, 20 bp, Homo sapiens
cccaggaggaggctgggccc

SEQ ID NO: 632 - DNA, 20 bp, Homo sapiens
gagtgagttggattaaactg

SEQ ID NO: 633 - DNA, 20 bp, Homo sapiens
ctgctatacgcgaagttgcc

SEQ ID NO: 634 - DNA, 20 bp, Homo sapiens
acgttctagattcacatgtc

SEQ ID NO: 635 - DNA, 20 bp, Homo sapiens
ctgaaaaaggaaggagttga

SEQ ID NO: 636 - DNA, 20 bp, Homo sapiens
aagatgaaaggaaaggcgtt

What is claimed is:

1. A method of screening for gain of function (GOF) or loss of function (LOF), comprising:
   (a) introducing a guide RNA (sgRNA) into cells of a mammalian cell line containing or expressing a CRISPR enzyme having at least one mutation, such that the CRISPR enzyme has no more than 5% of the nuclease activity of the CRISPR enzyme not having the at least one mutation, wherein the CRISPR enzyme is Cas9,
   wherein the sgRNA comprises
      (i) a guide sequence capable of hybridizing to a target sequence in a genomic locus of interest in the cells of the mammalian cell line, and
      (ii) a modified loop comprising an insertion of a distinct RNA sequence(s) that binds to one or more adaptor proteins, wherein tetraloop and/or stem-loop 2 of the sgRNA is modified, wherein the one or more adaptor proteins is associated with or comprises one or more functional domains, and
   (b) monitoring for GOF or LOF.

2. The method of claim 1, wherein the CRISPR enzyme has a diminished nuclease activity of at least 97% as compared with the CRISPR enzyme not having the at least one mutation.

3. The method of claim 1, wherein the CRISPR enzyme comprises two or more mutations in a residue selected from D10, E762, H840, N854, N863, or D986 according to a *Streptococcus pyogenes* Cas9 (SpCas9) protein or any corresponding ortholog or N580 according to a *Staphylococcus aureus* Cas9 (SaCas9) protein are mutated.

4. The method of claim 1, wherein the at least one mutation is an H840A mutation according to a *Streptococcus pyogenes* Cas9 protein.

5. The method of claim 1, wherein the CRISPR enzyme comprises a mutation selected from H840A, or D10A and H840A, or D10A and N863A, according to a *Streptococcus pyogenes* Cas9 (SpCas9) protein or any corresponding ortholog.

6. The method of claim 1, wherein the CRISPR enzyme comprises: N580A according to a *Staphylococcus aureus* Cas9 (SaCas9) protein or any corresponding ortholog; or D10A according to a *Streptococcus pyogenes* Cas9 (SpCas9) protein, or any corresponding ortholog, and N580A according to a SaCas9 protein.

7. The method of claim 1, wherein the CRISPR enzyme is associated with one or more functional domains.

8. The method of claim 1, wherein the one or more functional domains is a heterologous functional domain.

9. The method of claim 7, wherein the one or more functional domains associated with the CRISPR enzyme is a heterologous functional domain.

10. The method of claim 1, wherein the adaptor protein is a fusion protein comprising the one or more functional domains and a region that binds to the distinct RNA sequence(s) of the sgRNA, wherein the fusion protein optionally comprises a linker between the one or more functional domains and the region, and wherein the linker optionally comprises a GlySer linker.

11. The method of claim 1, wherein the sgRNA comprises at least one unmodified loop that does not comprise an insertion of the distinct RNA sequence(s).

12. The method of claim 11, wherein the unmodified loop comprises a tetraloop or a stem-loop 2.

13. The method of claim 1, wherein the one or more functional domains is a transcriptional activation domain.

14. The method of claim 7, wherein the one or more functional domains associated with the CRISPR enzyme is a transcriptional activation domain.

15. The method of claim 13, wherein the transcriptional activation domain comprises a transcriptional activation domain of VP64, p65, MyoD1, HSF1, RTA, or SET7/9.

16. The method of claim 14, wherein the transcriptional activation domain comprises a transcriptional activation domain of VP64, p65, MyoD1, HSF1, RTA, or SET7/9.

17. The method of claim 1, wherein the one or more functional domains is a transcriptional repressor domain.

18. The method of claim 7, wherein the one or more functional domains associated with the CRISPR enzyme is a transcriptional repressor domain.

19. The method of claim 17, wherein the transcriptional repressor domain is a KRAB domain, NuE domain, NcoR domain, SID domain or a SID4X domain.

20. The method of claim 18, wherein the transcriptional repressor domain is a KRAB domain, NuE domain, NcoR domain, SID domain or a SID4X domain.

21. The method of claim 1, wherein the one or more functional domains has one or more activities comprising methylase activity, demethylase activity, transcription activation activity, transcription repression activity, transcription release factor activity, histone modification activity, RNA cleavage activity, DNA cleavage activity, DNA integration activity or nucleic acid binding activity.

22. The method of claim 7, wherein the one or more functional domains associated with the CRISPR enzyme has one or more activities comprising methylase activity, demethylase activity, transcription activation activity, transcription repression activity, transcription release factor activity, histone modification activity, RNA cleavage activity, DNA cleavage activity, DNA integration activity, nucleic acid binding activity, or molecular switch activity or chemical inducibility or light inducibility.

23. The method of claim 21, wherein the DNA cleavage activity is due to a nuclease.

24. The method of claim 23, wherein the nuclease comprises a Fok1 nuclease.

25. The method of claim 1, further comprising introducing the one or more adaptor proteins into the cells of the mammalian cell line.

26. The method of claim 1, further comprising introducing the one or more functional domains into the cells of the mammalian cell line.

27. The method of claim 7, further comprising introducing the one or more functional domains associated with the CRISPR enzyme into the cells of the mammalian cell line.

28. The method of claim 1, wherein the sgRNA comprises at least two modified loops, wherein each modified loop is modified by insertion of a distinct RNA sequence that binds to one or more adaptor proteins.

29. The method of claim 28, wherein the two modified loops are a tetraloop and a stem-loop 2.

30. The method of claim 28, wherein the two modified loops are modified by insertion of the same distinct RNA sequence.

31. The method of claim 28, wherein the two modified loops are modified by insertion of different distinct RNA sequences.

32. The method of claim 30, wherein the distinct RNA sequence inserted into the two modified loops are bound by adaptor proteins associated with or comprising the same functional domain.

33. The method of claim 30, wherein the distinct RNA sequence inserted into the two modified loops are bound by adaptor proteins associated with or comprising different functional domains.

34. The method of claim 31, wherein the distinct RNA sequences inserted into the two modified loops are bound by adaptor proteins associated with or comprising the functional domain.

35. The method of claim 31, wherein the distinct RNA sequences inserted into the two modified loops are bound by adaptor proteins associated with or comprising different functional domains.

36. The method of claim 1, wherein the CRISPR enzyme comprises at least one or more nuclear localization sequences.

* * * * *